United States Patent
Damude et al.

(10) Patent No.: US 7,932,077 B2
(45) Date of Patent: Apr. 26, 2011

(54) HIGH EICOSAPENTAENOIC ACID PRODUCING STRAINS OF YARROWIA LIPOLYTICA

(75) Inventors: Howard Glenn Damude, Hockessin, DE (US); Peter John Gillies, Landenberg, PA (US); Daniel Joseph Macool, Philadelphia, PA (US); Stephen K. Picataggio, Landenberg, PA (US); Dana M. Walters Pollak, Media, PA (US); James John Ragghianti, Bear, DE (US); Zhixiong Xue, Chadds Ford, PA (US); Narendra S. Yadav, Chadds Ford, PA (US); Hongxiang Zhang, Chadds Ford, PA (US); Quinn Qun Zhu, West Chester, PA (US)

(73) Assignee: E. I. du Pont de Nemours and Company, Wilmington, DE (US)

( * ) Notice: Subject to any disclaimer, the term of this patent is extended or adjusted under 35 U.S.C. 154(b) by 1119 days.

(21) Appl. No.: 11/265,761

(22) Filed: Nov. 2, 2005

(65) Prior Publication Data

US 2006/0115881 A1  Jun. 1, 2006

Related U.S. Application Data

(60) Provisional application No. 60/624,812, filed on Nov. 4, 2004.

(51) Int. Cl.
- *C12N 1/16* (2006.01)
- *C12N 9/02* (2006.01)
- *C12N 9/08* (2006.01)
- *C12P 7/64* (2006.01)
- *C07H 21/04* (2006.01)

(52) U.S. Cl. ............... 435/254.2; 435/254.11; 435/134; 435/189; 435/193; 536/23.2

(58) Field of Classification Search ............... 435/254.2, 435/6, 69.1, 320.1, 183, 134; 536/23.2
See application file for complete search history.

(56) References Cited

U.S. PATENT DOCUMENTS

| | | | |
|---|---|---|---|
| 5,244,921 A | 9/1993 | Kyle et al. | |
| 5,246,841 A | 9/1993 | Yazawa et al. | |
| 5,246,842 A | 9/1993 | O'Brien et al. | |
| 5,401,646 A | 3/1995 | Shinmen et al. | |
| 6,136,574 A | 10/2000 | Knutzon et al. | |
| 6,331,568 B1 | 12/2001 | Horrobin | |
| 6,624,195 B2 | 9/2003 | Horrobin | |
| 7,259,255 B2 * | 8/2007 | Picataggio et al. | 536/24.1 |
| 2005/0216975 A1 * | 9/2005 | Yadav et al. | 800/281 |
| 2006/0195939 A1 * | 8/2006 | Damude et al. | 800/281 |

FOREIGN PATENT DOCUMENTS

| | | | |
|---|---|---|---|
| WO | WO 00/34439 | * | 6/2000 |
| WO | WO 2004/101757 A2 | | 11/2004 |
| WO | WO 2004/104167 | * | 12/2004 |
| WO | WO 2005/047485 | * | 5/2005 |

OTHER PUBLICATIONS

Characterization and comparison of fatty acyl Delta6 desaturase cDNAs from freshwater and marine teleost fish species. Comp Biochem Physiol B Biochem Mol Biol. Oct. 2004;139(2):269-79.*
Janice McColl, Health Benefits of Omega-3 Fatty Acids, Nutraceuticals. vol. 2(4):35-40, 2003.
Frederic Domergue et al., Cloning and Functional Characterization of Phaeodactylum Tricornutum Front-End Desaturases Involved in Eicosapentaenoic Acid Biosynthesis, Eur. J. Biochem., vol. 269:4105-4113, 2002.
Baoxiu al et al., Production of Very Long Chain Polyunsaturated Omega-3 and Omega-6 Fatty Acids in Plants, Nature Biotechnology, vol. 22(6):739-745.
J. M. Dyer et al., Metabolic Engineering of *Saccharomyces cerevisiae* for Production of Novel Lipid Compounds, Appl. Microbiol. Biotechnol., vol. 59:224-230, 2002.
Baoxiu Qi et al., Identification of a CDNA Encoding a Novel C18-DELTA9 Polyunsaturated Fatty Acid-Specific Elongating Activity From the Docosahexaenoic Acid (DHA)-Producing Microalga, *Isochrysis galbana*, FEBS Letters, vol. 510:159-165, 2002.
James G. Wallis et al., The DELTA8-Desaturase of *Euglena gracilis*: An Alternate Pathway for Synthesis of 20-Carbon Polyunsaturated Fatty Acids, Archives of Biochemistry and Biophysics, vol. 365(2):307-316, 1999.
Casimir C. Akoh et al., Healthful Lipids, AOCS: Champaign, IL, 2005; Chapters 14-16.
Juretzek, Thomas et al., Vectors for gene expression and amplification in the yeast *Yarrowia lipolytica*, Yeast, 2001, p. 97-113, vol. 18, John Wiley & Sons, Ltd.
Sayanova, Olga V. et al., Eicosapentaenoic acid: biosynthetic routes and the potential for synthesis in transgenic plants, Phytochemistry, 2004, p. 147-158, vol. 65, Elsevier Ltd.
Hobbs, Douglas H. et al., Cloning of a cDNA encoding diacylglycerol acyltransferase from *Arabidopsis thaliana* and its functional expression, FEBS Letters, 1999, p. 145-159, vol. 452, Federal of European Biochemical Societies.

* cited by examiner

*Primary Examiner* — Robert B Mondesi
*Assistant Examiner* — Iqbal H Chowdhury

(57) ABSTRACT

Engineered strains of the oleaginous yeast *Yarrowia lipolytica* capable of producing greater than 25% eicosapentaenoic acid (EPA, an ω-3 polyunsaturated fatty acid) in the total oil fraction are described. These strains comprise various chimeric genes expressing heterologous desaturases, elongases and acyltransferases and optionally comprise various native desaturase and acyltransferase knockouts to enable synthesis and high accumulation of EPA. Production host cells are claimed, as are methods for producing EPA within said host cells.

10 Claims, 40 Drawing Sheets

```
                ******* *                     *******************  ********
SEQ ID NO: 58   MKSKRQAL-PLTIDGTTYDVSAWVNFHPGGAEIIENYQGRDATDAFMVMHSQEAFDKLKR
SEQ ID NO: 60   MKSKRQAL-PLTIDGTTYDVSAWVNFHPGGAEIIENYQGRDATDAFMVMHSQEAFDKLKR
SEQ ID NO: 53   MKSKRQALSPLQLMEQTYDV---VNFHPGGAEIIENYQGRDATDAFMVMHFQEAFDKLKR
SEQ ID NO: 54   MKSKRQALSPLQLMEQTYDVSAWVNFHPGGAEIIENYQGRDATDAFMVMHFQEAFDKLKR

****** ******************************************* *******
SEQ ID NO: 58   MPKINPSSELPPQAAVNEAQEDFRKLREELIATGMFDASPLWYSYKISTTLGLGVLGYFL
SEQ ID NO: 60   MPKINPSSELPPQAAVNEAQEDFRKLREELIATGMFDASPLWYSYKISTTLGLGVLGYFL
SEQ ID NO: 53   MPKINPSFELPPQAAVNEAQEDFRKLREELIATGMFDASPLWYSYKISTTLGLGVLGYFL
SEQ ID NO: 54   MPKINPSFELPPQAAVNEAQEDFRKLREELIATGMFDASPLWYSYKISTTLGLGVLGYFL

***********************************************************  **
SEQ ID NO: 58   MVQYQMYFIGAVLLGMHYQQMGWLSHDICHHQTFKNRNWNNLVGLVFGNGLQGFSVTWWK
SEQ ID NO: 60   MVQYQMYFIGAVLLGMHYQQMGWLSHDICHHQTFKNRNWNNLVGLVFGNGLQGFSVTWWK
SEQ ID NO: 53   MVQYQMYFIGAVLLGMHYQQMGWLSHDICHHQTFKNRNWNNLVGLVFGNGLQGFSVTCWK
SEQ ID NO: 54   MVQYQMYFIGAVLLGMHYQQMGWLSHDICHHQTFKNRNWNNLVGLVFGNGLQGFSVTCWK

***************************  *****************************
SEQ ID NO: 58   DRHNAHHSATNVQGHDPDIDNLPLLAWSEDDVTRASPISRKLIQFQQYYFLVICILLRFI
SEQ ID NO: 60   DRHNAHHSATNVQGHDPDIDNLPLLAWSEDDVTRASPISRKLIQFQQYYFLVICILLRFI
SEQ ID NO: 53   DRHNAHHSATNVQGHDPDIDNLPPLAWSEDDVTRASPISRKLIQFQQYYFLVICILLRFI
SEQ ID NO: 54   DRHNAHHSATNVQGHDPDIDNLPPLAWSEDDVTRASPISRKLIQFQQYYFLVICILLRFI

******************************  ***************************
SEQ ID NO: 58   WCFQSVLTVRSLKDRDNQFYRSQYKKEAIGLALHWTLKTLFHLFFMPSILTSLLVFFVSE
SEQ ID NO: 60   WCFQSVLTVRSLKDRDNQFYRSQYKKEAIGLALHWTLKALFHLFFMPSILTSLLVFFVSE
SEQ ID NO: 53   WCFQCVLTVRSLKDRDNQFYRSQYKKEAIGLALHWTLKALFHLFFMPSILTSLLVFFVSE
SEQ ID NO: 54   WCFQCVLTVRSLKDRDNQFYRSQYKKEAIGLALHWTLKALFHLFFMPSILTSLLVFFVSE

******************************  ***************************
SEQ ID NO: 58   LVGGFGIAIVVFMNHYPLEKIGDSVWDGHGFSVGQIHETMNIRRGIITDWFFGGLNYQIE
SEQ ID NO: 60   LVGGFGIAIVVFMNHYPLEKIGDSVWDGHGFSVGQIHETMNIRRGIITDWFFGGLNYQIE
SEQ ID NO: 53   LVGGFGIAIVVFMNHYPLEKIGDPVWDGHGFSVGQIHETMNIRRGIITDWFFGGLNYQIE
SEQ ID NO: 54   LVGGFGIAIVVFMNHYPLEKIGDPVWDGHGFSVGQIHETMNIRRGIITDWFFGGLNYQIE

************************************************************
SEQ ID NO: 58   HHLWPTLPRHNLTAVSYQVEQLCQKHNLPYRNPLPHEGLVILLRYLAVFARMAEKQPAGK
SEQ ID NO: 60   HHLWPTLPRHNLTAVSYQVEQLCQKHNLPYRNPLPHEGLVILLRYLAVFARMAEKQPAGK
SEQ ID NO: 53   HHLWPTLPRHNLTAVSYQVEQLCQKHNLPYRNPLPHEGLVILLRYLAVFARMAEKQPAGK
SEQ ID NO: 54   HHLWPTLPRHNLTAVSYQVEQLCQKHNLPYRNPLPHEGLVILLRYLAVFARMAEKQPAGK

*
SEQ ID NO: 58   AL.
SEQ ID NO: 60   AL.
SEQ ID NO: 53   A-L
SEQ ID NO: 54   A-L
```

FIG. 13

HIGH EICOSAPENTAENOIC ACID PRODUCING STRAINS OF *YARROWIA LIPOLYTICA*

This application claims the benefit of U.S. Provisional Application No. 60/624,812, filed Nov. 4, 2004.

FIELD OF THE INVENTION

This invention is in the field of biotechnology. More specifically, this invention pertains to an engineered strain of the oleaginous yeast *Yarrowia lipolytica* that is capable of efficiently producing eicosapentaenoic acid (an ω-3 polyunsaturated fatty acid) in high concentrations.

BACKGROUND OF THE INVENTION

Eicosapentaenoic acid (EPA; cis-5, 8, 11, 14, 17-eicosapentaenoic acid; ω-3) is an important intermediate in the biosynthesis of biologically active prostaglandin. Additionally, EPA is recognized as having clinical and pharmaceutical value. For example, the following pharmacological actions of EPA are known: (1) platelet coagulation inhibitory action (thrombolytic action); (2) blood neutral fat-lowering action; (3) actions for lowering blood VLDL-cholesterol and LDL-cholesterol and increasing HDL-cholesterol (anti-arterial sclerosis action); (4) blood viscosity-lowering action; (5) blood pressure lowering action; (6) anti-inflammatory action; and (7) anti-tumor action. As such, EPA provides a natural approach to lower blood cholesterol and triglycerides. Increased intake of EPA has been shown to be beneficial or have a positive effect in coronary heart disease, high blood pressure, inflammatory disorders (e.g., rheumatoid arthritis), lung and kidney diseases, Type II diabetes, obesity, ulcerative colitis, Crohn's disease, anorexia nervosa, burns, osteoarthritis, osteoporosis, attention deficit/hyperactivity disorder, and early stages of colorectal cancer (see, for example, the review of McColl, J., *NutraCos* 2(4):3540 (2003); Sinclair, A., et al. In *Healthful Lipids*; C. C. Akoh and O.-M. Lai, Eds; AOCS: Champaign, Ill., 2005; Chapter 16). Recent findings have also confirmed the use of EPA in the treatment of mental disorders, such as schizophrenia (U.S. Pat. No. 6,331,568; U.S. Pat. No. 6,624,195). Lastly, EPA is also used in products relating to functional foods (nutraceuticals), infant nutrition, bulk nutrition, cosmetics and animal health.

Although EPA is naturally found in different types of fish oil and marine plankton, it is expected that the supply of this ω-3 fatty acid will not be sufficient to meet the growing demand. Fish oils have highly heterogeneous compositions (thereby requiring extensive purification to enrich for EPA), unpleasant tastes and odors (making removal economically difficult and rendering the oils unacceptable as food ingredients), and are subject to environmental bioaccumulation of heavy metal contaminants and fluctuations in availability (due to weather, disease or over-fishing).

As an alternate to fish oil, EPA can also be produced microbially. Generally, microbial oil production involves cultivating an appropriate microorganism that is naturally capable of synthesizing EPA in a suitable culture medium to allow for oil synthesis (which occurs in the ordinary course of cellular metabolism), followed by separation of the microorganism from the fermentation medium and treatment for recovery of the intracellular oil. Numerous different processes exist based on the specific microbial organism utilized [e.g., heterotrophic diatoms *Cyclotella* sp. and *Nitzschia* sp. (U.S. Pat. No. 5,244,921); *Pseudomonas, Alteromonas* or *Shewanella* species (U.S. Pat. No. 5,246,841); filamentous fungi of the genus *Pythium* (U.S. Pat. No. 5,246,842); or *Mortierella elongata, M. exigua,* or *M. hygrophila* (U.S. Pat. No. 5,401,646)]. These methods all suffer from an inability to substantially improve the yield of oil or to control the characteristics of the oil composition produced, since the fermentations rely on the natural abilities of the microbes themselves. Furthermore, large-scale fermentation of some organisms (e.g., *Porphyridium, Mortierella*) can also be expensive and/or difficult to cultivate on a commercial scale.

Thus, microbial production of EPA using recombinant means is expected to have several advantages over production from natural microbial sources. For example, recombinant microbes having preferred characteristics for oil production can be used, since the naturally occurring microbial fatty acid profile of the host can be altered by the introduction of new biosynthetic pathways in the host and/or by the suppression of undesired pathways, thereby resulting in increased levels of production of desired PUFAs (or conjugated forms thereof) and decreased production of undesired PUFAs. Secondly, recombinant microbes can provide PUFAs in particular forms which may have specific uses. Additionally, microbial oil production can be manipulated by controlling culture conditions, notably by providing particular substrate sources for microbially expressed enzymes, or by addition of compounds/genetic engineering to suppress undesired biochemical pathways. Thus, for example, it is possible to modify the ratio of ω-3 to ω-6 fatty acids so produced, or engineer production of a specific PUFA (e.g., EPA) without significant accumulation of other PUFA downstream or upstream products.

Most microbially produced EPA is synthesized via the Δ6 desaturase/Δ6 elongase pathway (which is predominantly found in, algae, mosses, fungi, nematodes and humans) and wherein: 1.) oleic acid is converted to LA by the action of a Δ12 desaturase; 2.) optionally, LA is converted to ALA by the action of a Δ15 desaturase; 3.) LA is converted to GLA, and/or ALA is converted to STA, by the action of a Δ6 desaturase; 3.) GLA is converted to DGLA, and/or STA is converted to ETA, by the action of a $C_{18/20}$ elongase; 3.) DGLA is converted to ARA, and/or ETA is converted to EPA, by the action of a Δ5 desaturase; and 4.) optionally, ARA is converted to EPA by the action of a Δ17 desaturase (FIG. 1). However, an alternate Δ9 elongase/Δ8 desaturase pathway for the biosynthesis of EPA operates in some organisms, such as euglenoid species, where it is the dominant pathway for formation of $C_{20}$ PUFAs (Wallis, J. G., and Browse, *J. Arch. Biochem. Biophys.* 365:307-316 (1999); WO 00/34439; and Qi, B. et al. *FEBS Letters.* 510:159-165 (2002)). In this pathway, 1.) LA and ALA are converted to EDA and ETrA, respectively, by a Δ9 elongase; 2.) EDA and ETrA are converted to DGLA and ETA, respectively, by a Δ8 desaturase; and 3.) DGLA and ETA are ultimately converted to EPA, as described above.

As such, the literature reports a number of recent examples whereby various portions of the ω-3/ω-6 PUFA biosynthetic pathway (responsible for EPA production) have been introduced into *Saccharomyces cerevisiae* (a non-oleaginous yeast). Specifically, Dyer, J. M. et al. (*Appl. Env. Microbiol.*, 59:224-230 (2002)) reported synthesis of linolenic acids upon expression of the plant fatty acid desaturases (FAD2 and FAD3); Knutzon et al. (U.S. Pat. No. 6,136,574) expressed one desaturase from *Brassica napus* and two desaturases from the fungus *Mortierella alpina* in *S. cerevisiae*, leading to the production of linolenic acid (LA), γ-linolenic acid (GLA), ALA and stearidonic acid (STA); and Domergue, F. et al. (*Eur. J. Biochem.* 269:4105-4113 (2002)) expressed two desaturases from the marine diatom *Phaeodactylum tricor-* nutum in *S. cerevisiae*, leading to the production of EPA. Similar successes have been reported in plants (e.g., Qi, B. et al., *Nature Biotech.* 22:739-745 (2004)).

Thus, although genes encoding the Δ6 desaturase/Δ6 elongase and the Δ9 elongase/Δ8 desaturase pathways have now been identified and characterized from a variety of organisms, and some have been heterologously expressed in combination with other PUFA desaturases and elongases, neither of these pathways have been introduced into a microbe, such as a yeast, and manipulated via complex metabolic engineering to enable economical production of commercial quantities of EPA (i.e., greater than 10% with respect to total fatty acids). Additionally, considerable discrepancy exists concerning the most appropriate choice of host organism for such engineering.

Recently, Picataggio et al. (WO 2004/101757) have explored the utility of oleaginous yeast, and specifically, *Yarrowia lipolytica* (formerly classified as *Candida lipolytica*), as a preferred class of microorganisms for production of PUFAs such as EPA. Oleaginous yeast are defined as those yeast that are naturally capable of oil synthesis and accumulation, wherein oil accumulation can be up to about 80% of the cellular dry weight. Despite a natural deficiency in the production of ω-6 and ω-3 fatty acids in these organisms (since naturally produced PUFAs are limited to 18:2 fatty acids (and less commonly, 18:3 fatty acids)), Picataggio et al. (supra) have demonstrated production of 1.3% ARA and 1.9% EPA (of total fatty acids) in *Y. lipolytica* using relatively simple genetic engineering approaches. More complex metabolic engineering has not been performed to enable economic, commercial production of EPA in this particular host organism.

Applicants have solved the stated problem by engineering strains of *Yarrowia lipolytica* that are capable of producing greater than 25% EPA in the total oil fraction, using either the Δ6 desaturase/Δ6 elongase pathway or the Δ9 elongase/Δ8 desaturase pathway. Additional metabolic engineering and fermentation methods are provided to further enhance EPA productivity in these oleaginous yeast.

SUMMARY OF THE INVENTION

The present invention provides a production host for the production of EPA in microbial oil. The strain is a recombinant *Yarrowia* sp. incorporating a number of genetic elements and modifications that make it uniquely attractive for EPA production.

Accordingly the invention provides a recombinant production host cell for the production of eicosapentaenoic acid comprising a background *Yarrowia* sp. comprising a gene pool comprising the following genes of the ω-3/ω-6 fatty acid biosynthetic pathway:
 a) at least one gene encoding Δ6 desaturase; and,
 b) at least one gene encoding $C_{18/20}$ elongase; and,
 c) at least one gene encoding Δ5 desaturase; and,
 d) at least one gene encoding Δ17 desaturase;
wherein at least one of said ω-3ω-6 fatty acid biosynthetic pathway genes is over-expressed.

In another embodiment the invention provides a recombinant production host cell for the production of eicosapentaenoic acid comprising a background *Yarrowia* sp. comprising a gene pool comprising the following genes of the ω-3/ω-6 fatty acid biosynthetic pathway:
 a) at least one gene encoding Δ15 desaturase; and,
 b) at least one gene encoding Δ6 desaturase; and,
 c) at least one gene encoding $C_{18/20}$ elongase; and,
 d) at least one gene encoding Δ5 desaturase;
wherein at least one of said ω-3/ω-6 fatty acid biosynthetic pathway genes is over-expressed.

In an alternate embodiment the invention provides a recombinant production host cell for the production of eicosapentaenoic acid comprising a background *Yarrowia* sp. comprising a gene pool comprising the following genes of the ω-3/ω-6 fatty acid biosynthetic pathway:
 a) at least one gene encoding Δ9 elongase; and,
 b) at least one gene encoding Δ8 desaturase; and,
 c) at least one gene encoding Δ5 desaturase; and,
 d) at least one gene encoding Δ17 desaturase;
wherein at least one of said ω-3/ω-6 fatty acid biosynthetic pathway genes is over-expressed.

In another embodiment the invention provides A recombinant production host cell for the production of eicosapentaenoic acid comprising a background *Yarrowia* sp. comprising a gene pool comprising the following genes of the ω-3/ω-6 fatty acid biosynthetic pathway:
 a) at least one gene encoding Δ15 desaturase; and,
 b) at least one gene encoding Δ9 elongase; and,
 c) at least one gene encoding Δ8 desaturase; and,
 d) at least one gene encoding Δ5 desaturase;
wherein at least one of said ω-3/ω-6 fatty acid biosynthetic pathway genes is over-expressed.

Additional embodiments of the invention include the addition of at least one gene encoding Δ12 desaturase as part of the gene pool of the production hosts of the invention. The genes of the production hosts of the invention may be under the control of specific promoters having the nucleic acid sequence selected from the group consisting of SEQ ID NOs: 173-183 and 389, and may have additional genes comprising various elements of the ω-3/ω-6 fatty acid biosynthetic pathway.

In another embodiment the invention provides a method for the production of a microbial oil comprising eicosapentaenoic acid comprising:
 a) culturing the production host of the invention wherein a microbial oil comprising eicosapentaenoic acid is produced; and
 b) optionally recovering the microbial oil of step (a).

In additional embodiments the invention provides microbial oils made by the production hosts of the invention having concentrations of eicosapentaenoic acid ranging from at least 5% eicosapentaenoic acid to about at least 30% eicosapentaenoic acid.

In other embodiments the invention provides food and feed products comprising effective amounts of the microbial oils of the invention comprising eicosapentaenoic acid.

In another embodiment the invention comprises feed products comprising the microbial oils of the invention and additionally comprising yeast biomass added thereto for the supplementation of the feed product with various feed nutrients.

In other embodiments the invention provides methods of treating various clinical conditions by providing the microbial oils of the invention in forms consumable by humans and animals.

Biological Deposits

The following biological materials have been deposited with the American Type Culture Collection (ATCC), 10801 University Boulevard, Manassas, Va. 20110-2209, and bear the following designations, accession numbers and dates of deposit.

| Biological Material | Accession Number | Date of Deposit |
|---|---|---|
| Plasmid pY89-5 | ATCC PTA-6048 | June 4th, 2004 |
| Yarrowia lipolytica Y2047 | ATCC PTA-7186 | October 26th, 2005 |
| Yarrowia lipolytica Y2201 | ATCC PTA-7185 | October 26th, 2005 |
| Yarrowia lipolytica Y2096 | ATCC PTA-7184 | October 26th, 2005 |

BRIEF DESCRIPTION OF THE DRAWINGS AND SEQUENCE DESCRIPTIONS

Figure 5A:
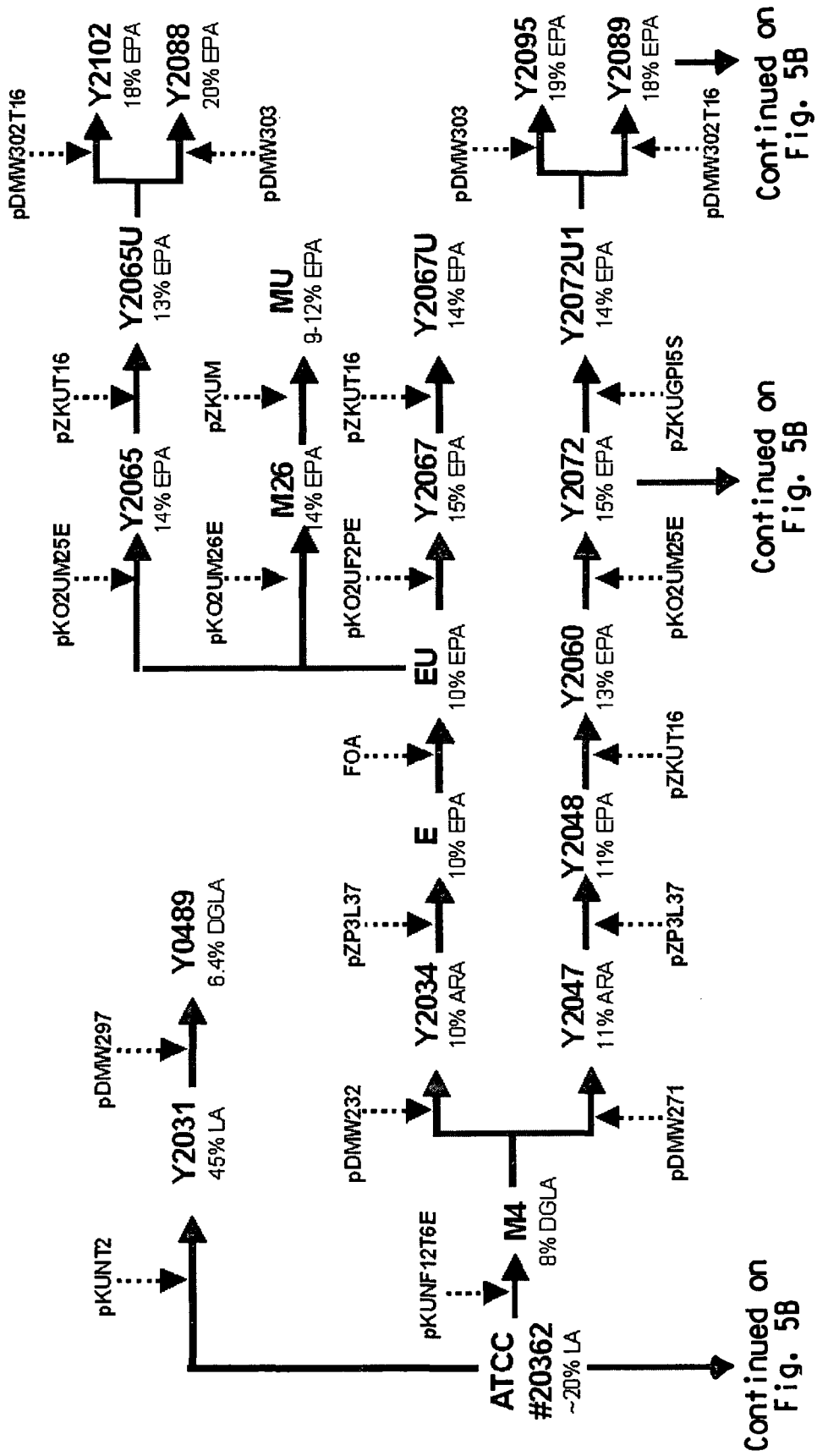
Figure 5B:
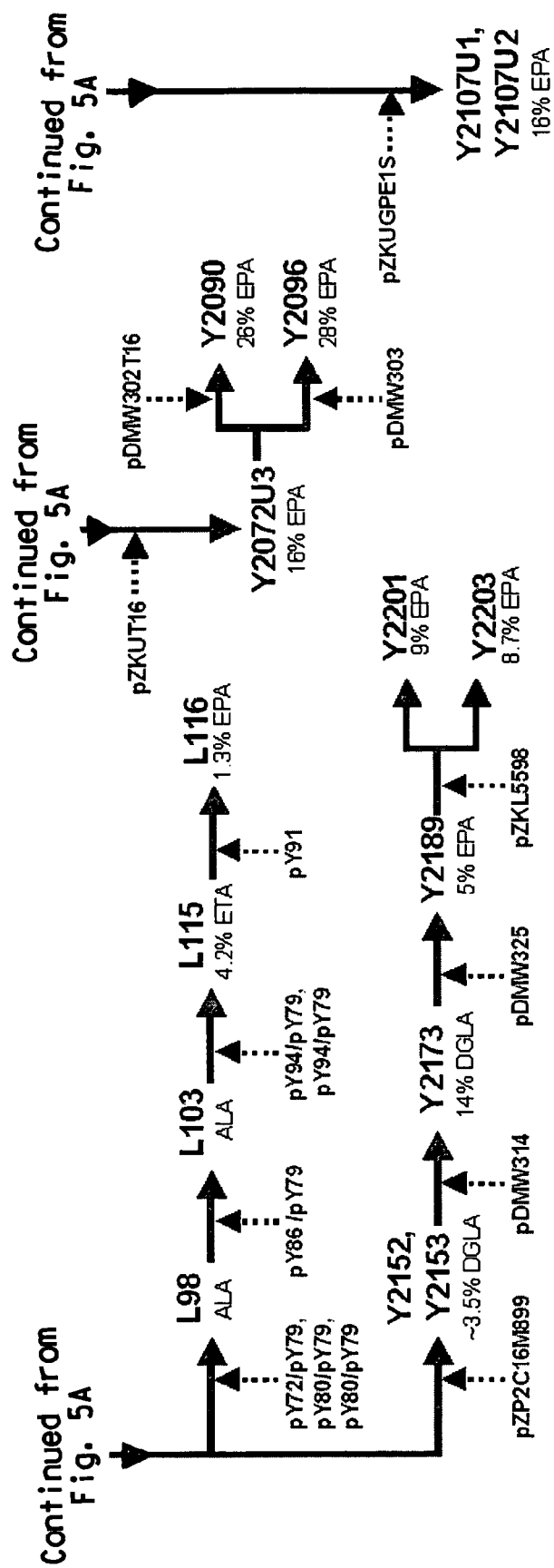

FIG. 5 diagrams the development of some Yarrowia lipolytica strains of the invention, producing various fatty acids (including EPA) in the total lipid fraction.

Figure 6:
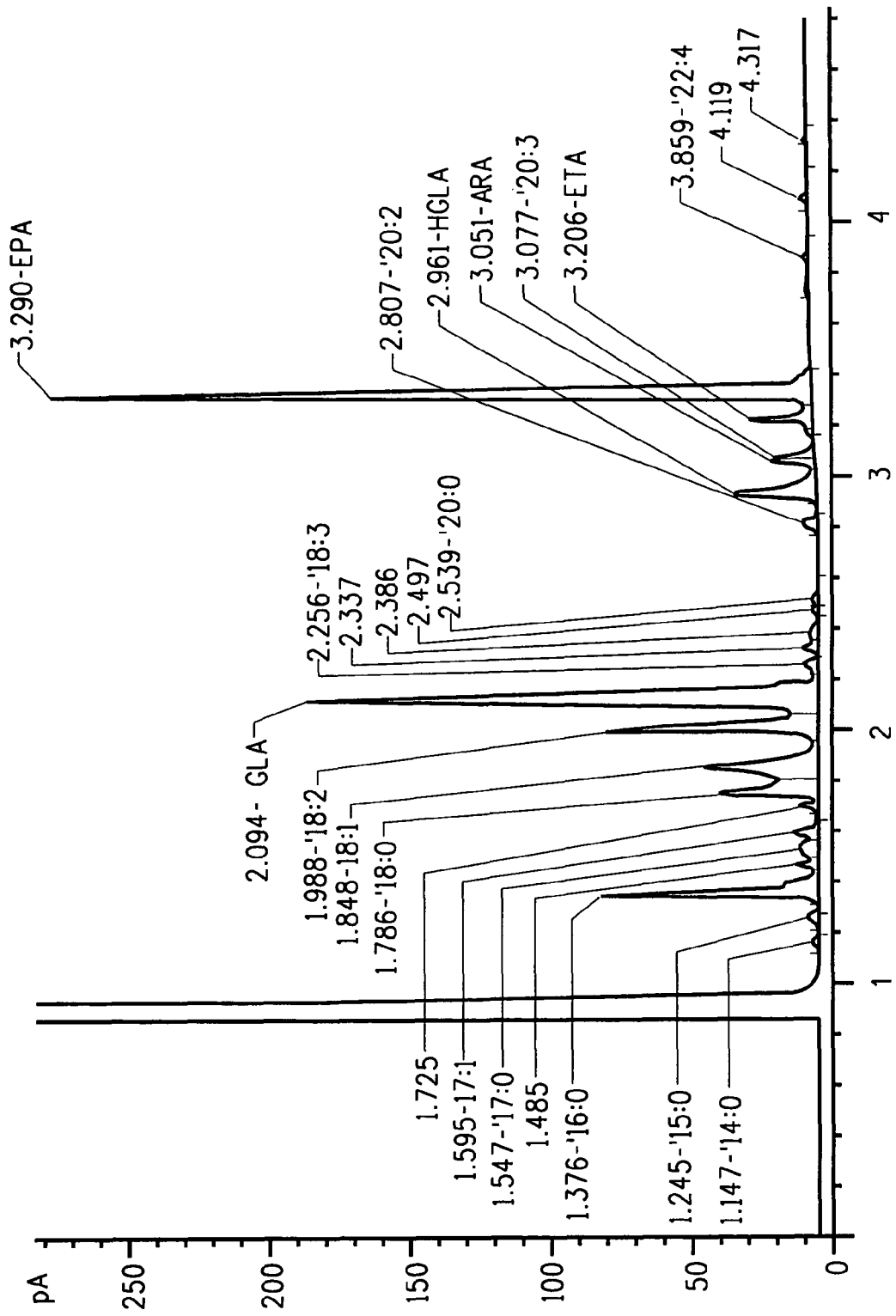

FIG. 6 is a GC chromatograph showing the fatty acid profile in Yarrowia lipolytica strain Y2096 producing 28% EPA in the total lipid fraction.

Figure 7A:
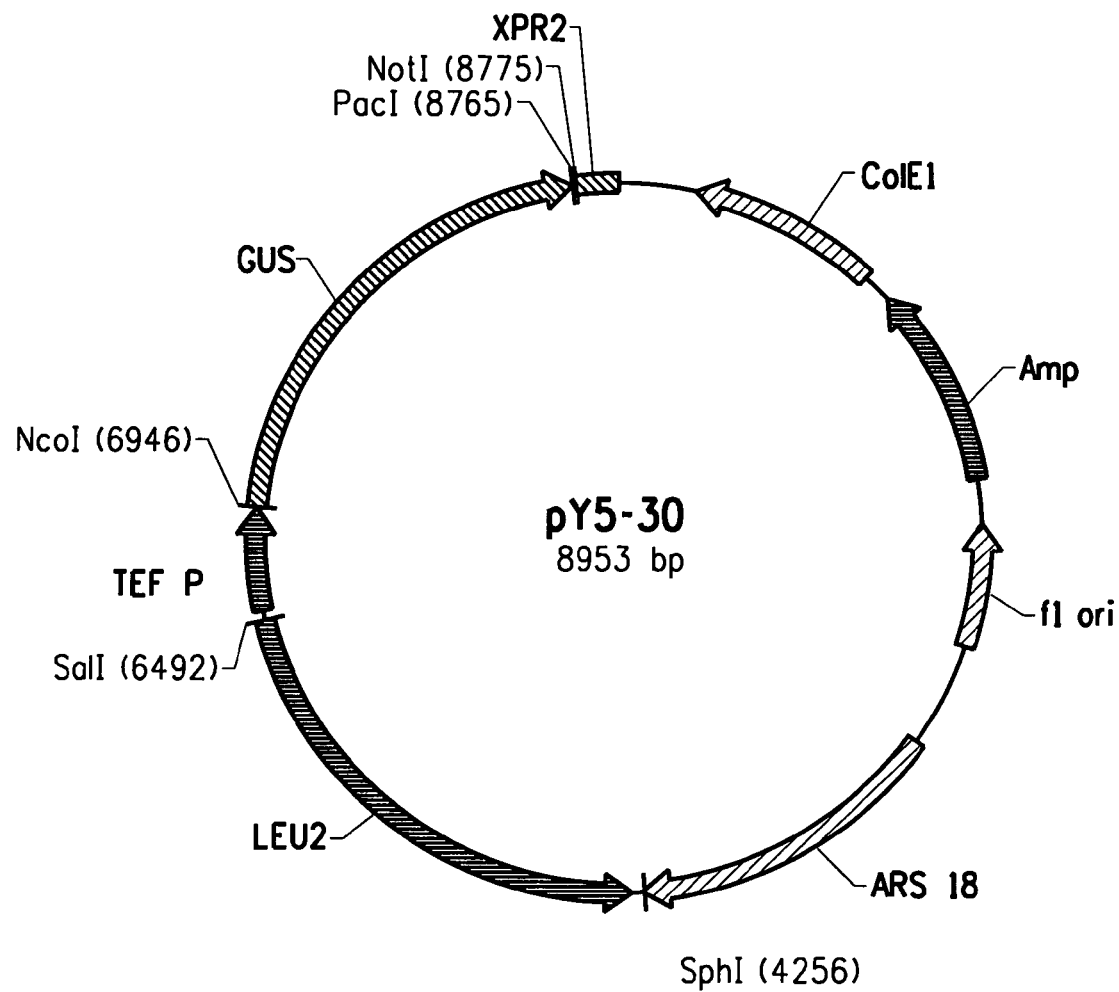
Figure 7B:
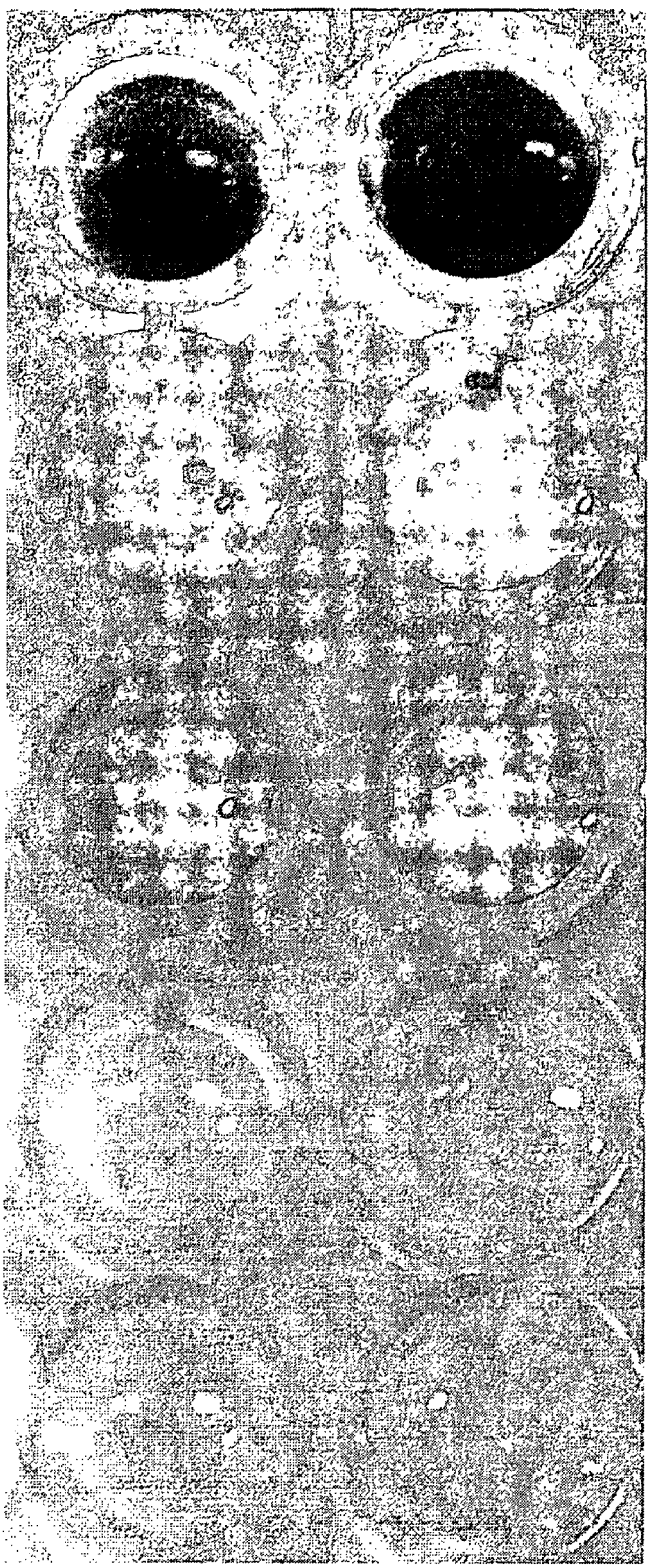
Figure 7C:
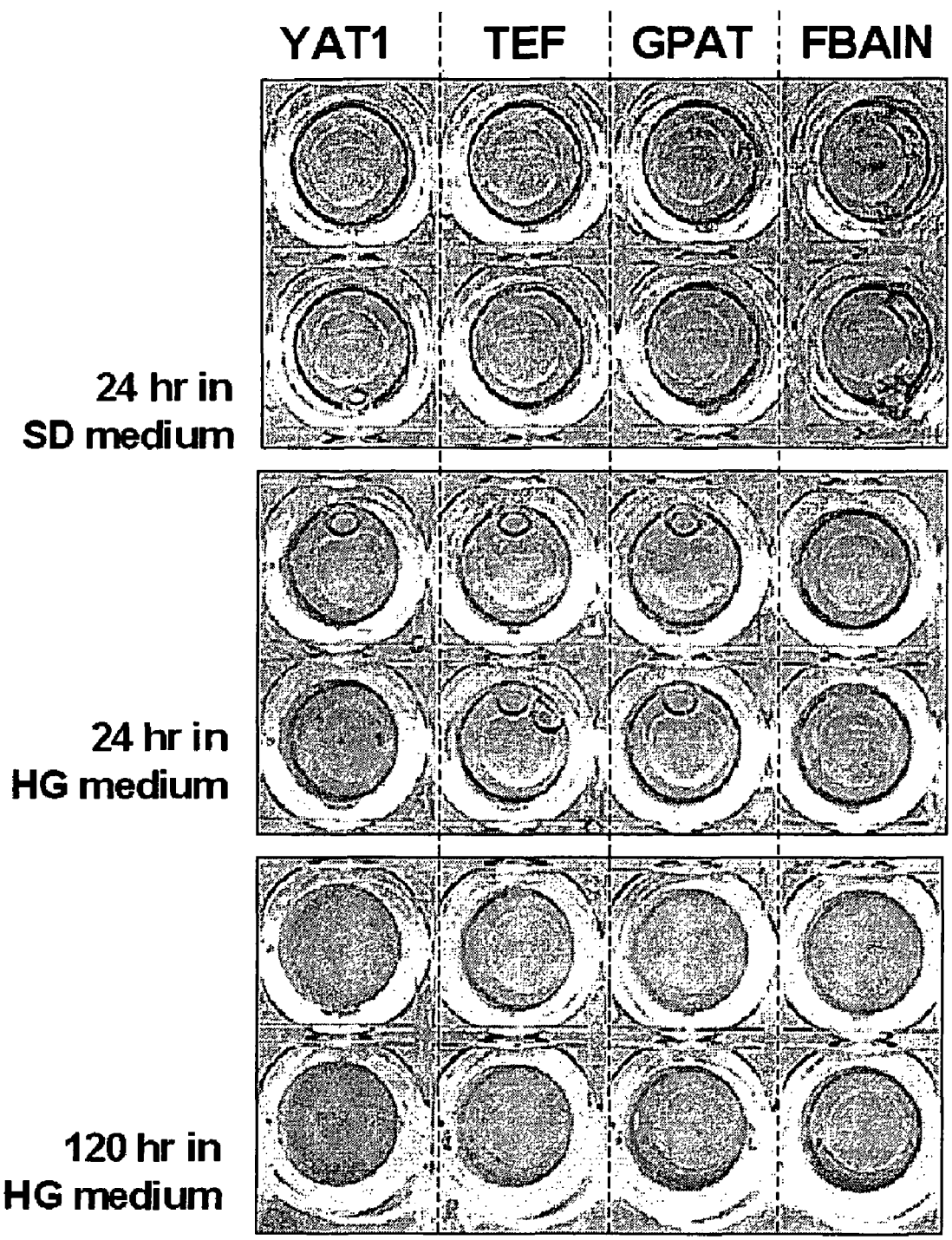

FIG. 7A provides a plasmid map for pY5-30. FIG. 7B illustrates the relative promoter activities of TEF, GPD, GPM, FBA and FBAIN in Yarrowia lipolytica ATCC #76982 strains, as determined by histochemical staining. FIG. 7C illustrates the relative promoter activities of YAT1, TEF, GPAT and FBAIN in Y. lipolytica grown in various media as determined by histochemical staining.

Figure 8A:
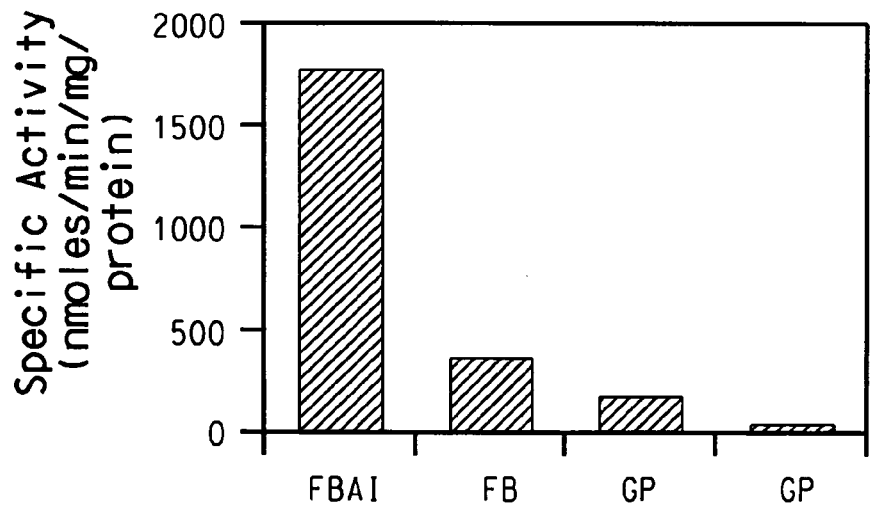
Figure 8B:
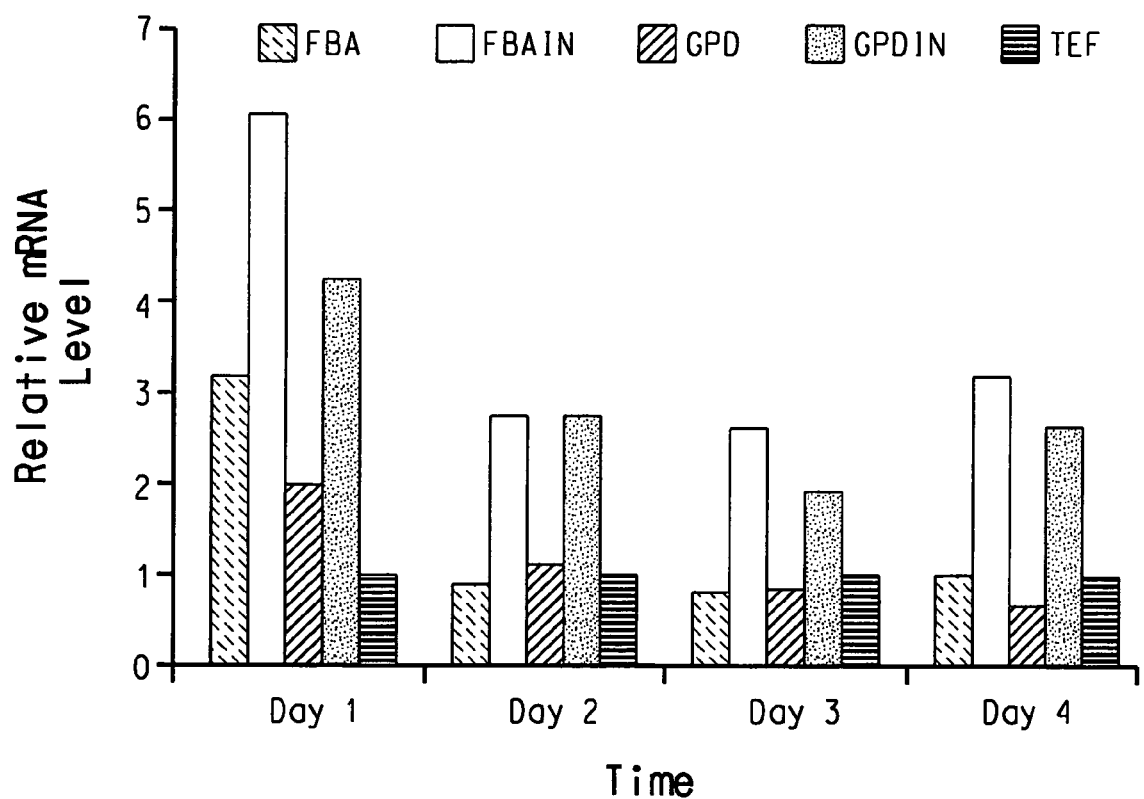

FIG. 8A is a graph comparing the promoter activity of GPD, GPM, FBA and FBAIN in Yarrowia lipolytica ATCC #76982 strains, as determined fluorometrically. FIG. 8B graphically summarizes the results of Real Time PCR relative quanitation, wherein the GUS mRNA in Yarrowia lipolytica ATCC #76982 strains (i.e., expressing GPD::GUS, GPDIN::GUS, FBA::GUS or FBAIN::GUS chimeric genes) was quantified to the mRNA level of the Y. lipolytica strain expressing pY5-30 (i.e., a chimeric TEF::GUS gene).

FIG. 9 provides plasmid maps for the following: (A) pKUNF12T6E; (B) pDMW232; (C) pZP3L37; (D) pY37/F15; and (E) pKO2UF2PE.

FIG. 10 provides plasmid maps for the following: (A) pZKUT16; (B) pKO2UM25E; (C) pDMW302T16; (D) pDMW303; and (E) pDMW271.

FIG. 11 provides plasmid maps for the following: (A) pZKUGPI5S; (B) pKO2UM26E; (C) pKUNT2; and (D) pZUF17.

Figure 12:
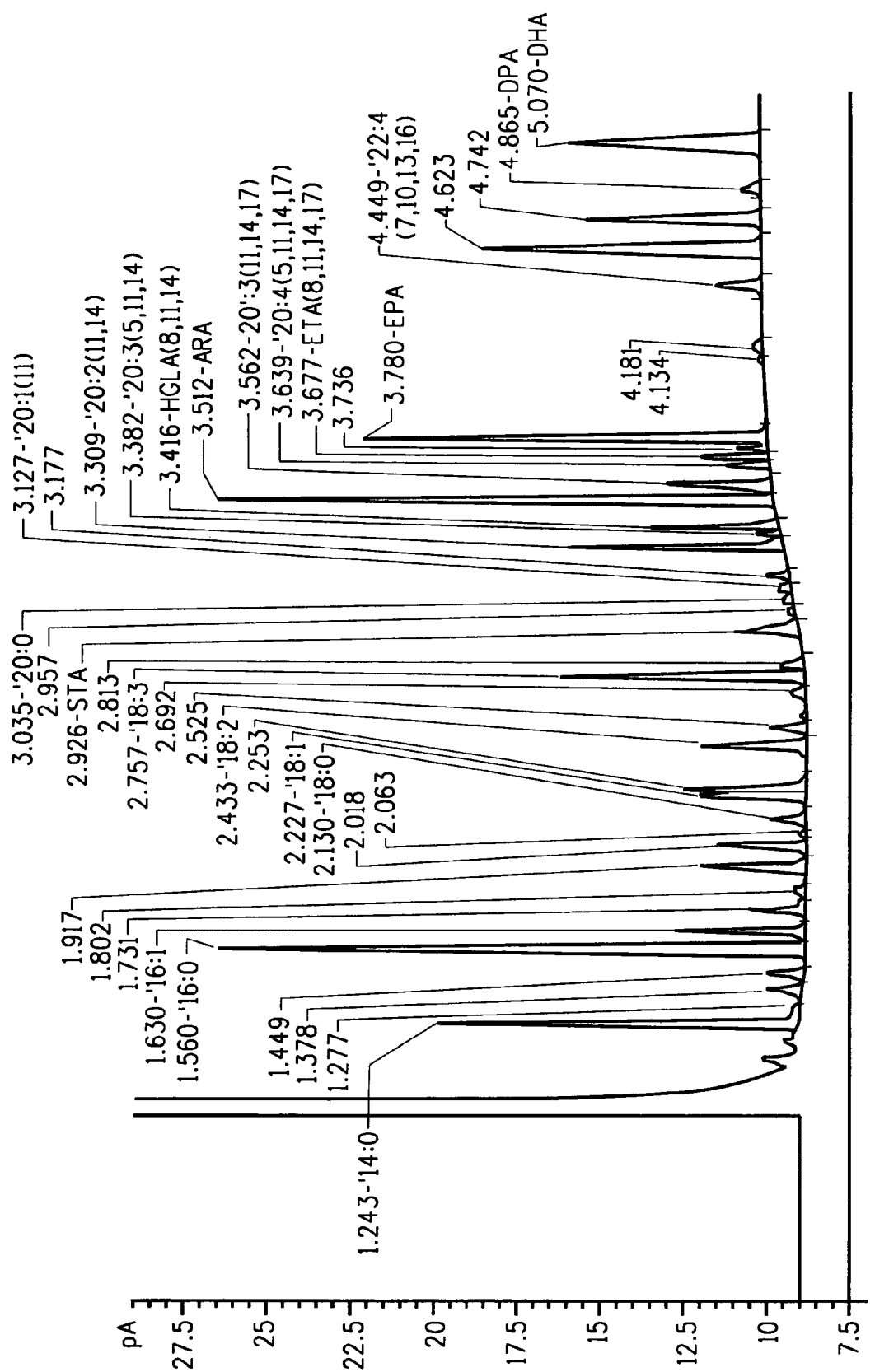

FIG. 12 shows a chromatogram of the lipid profile of an Euglena gracilis cell extract.

FIG. 13 shows an alignment of various Euglena gracilis Δ8 desaturase polypeptide sequences. The method of alignment used corresponds to the "Clustal V method of alignment".

FIG. 14 provides plasmid maps for the following: (A) pDMW237; (B) pDMW240; (C) yeast expression vector pY89-5; and (D) pKUNFmKF2.

FIG. 15 provides plasmid maps for the following: (A) pDMW277; (B) pZF5T-PPC; (C) pDMW287F; and (D) pDMW297.

FIG. 16 provides plasmid maps for the following: (A) pZP2C16M899; (B) pDMW314; (C) pDM325; and (D) pZKL5598.

FIG. 17 provides plasmid maps for the following: (A) pY72 [or "pY72.2Ioxp.Hyg.Fba.F15"]; (B) pY80 [or "pY80.Ioxp.2F15"]; (C) pY79 [or "pY79.Cre.AHASw497L"; and (D) pY86 [or "pY86.Ioxp.Ura3.Hyg.F12"].

FIG. 18 provides plasmid maps for the following: (A) pY94 [or "pY94.Ioxp.D9ED8.Ura3"]; (B) pY91M [or "pY91.Dr.D6M (native)"]; (C) pZUF-Mod-1; (D) pMDA-GAT1-17; and (E) pMGPAT-17.

Figure 19:
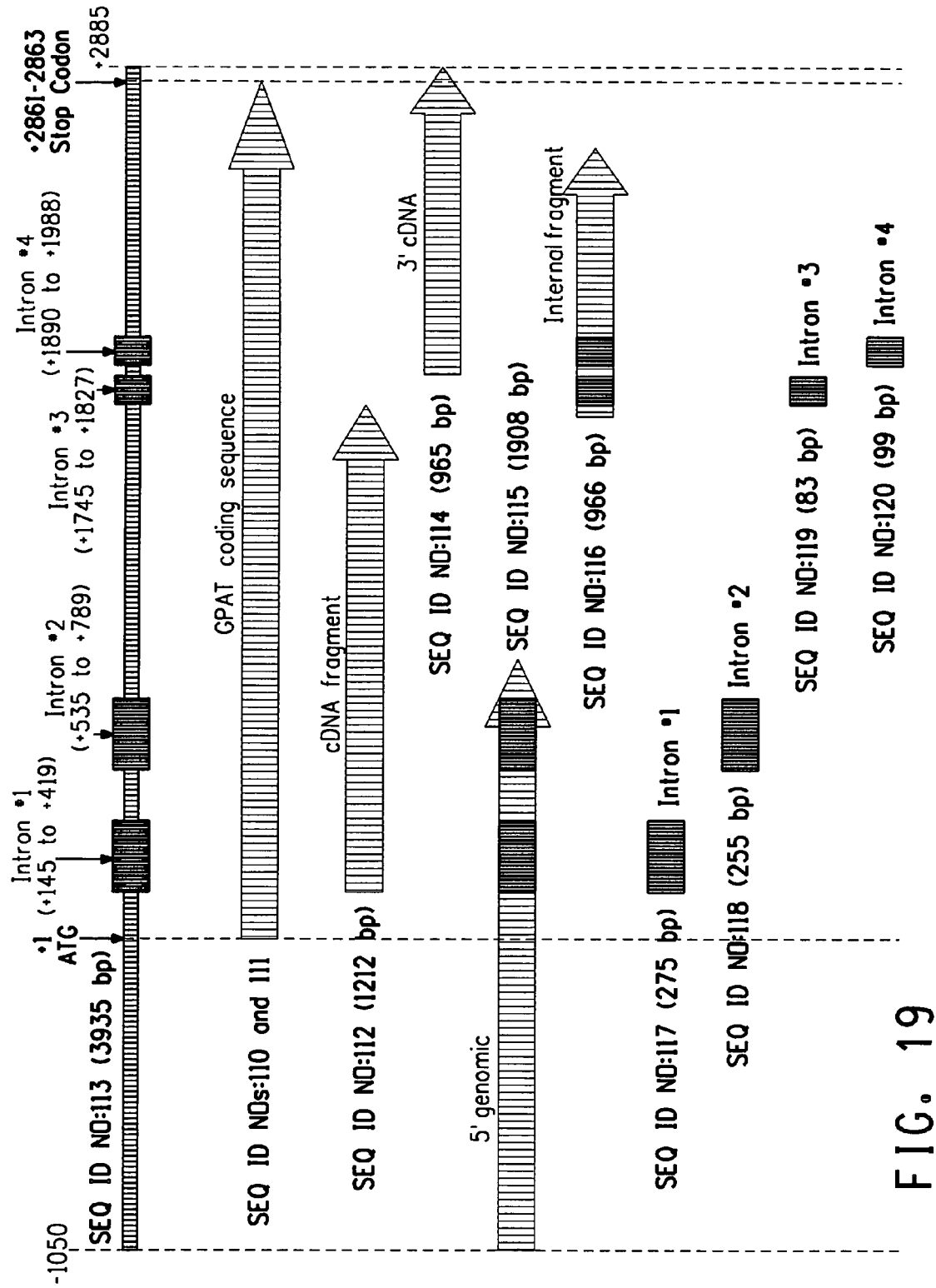

FIG. 19 graphically represents the relationship between SEQ ID NOs:110, 111, 112, 113, 114, 115, 116, 117, 118, 119 and 120, each of which relates to glycerol-3-phosphate o-acyltransferase (GPAT) in Mortierella alpina.

Figure 20:
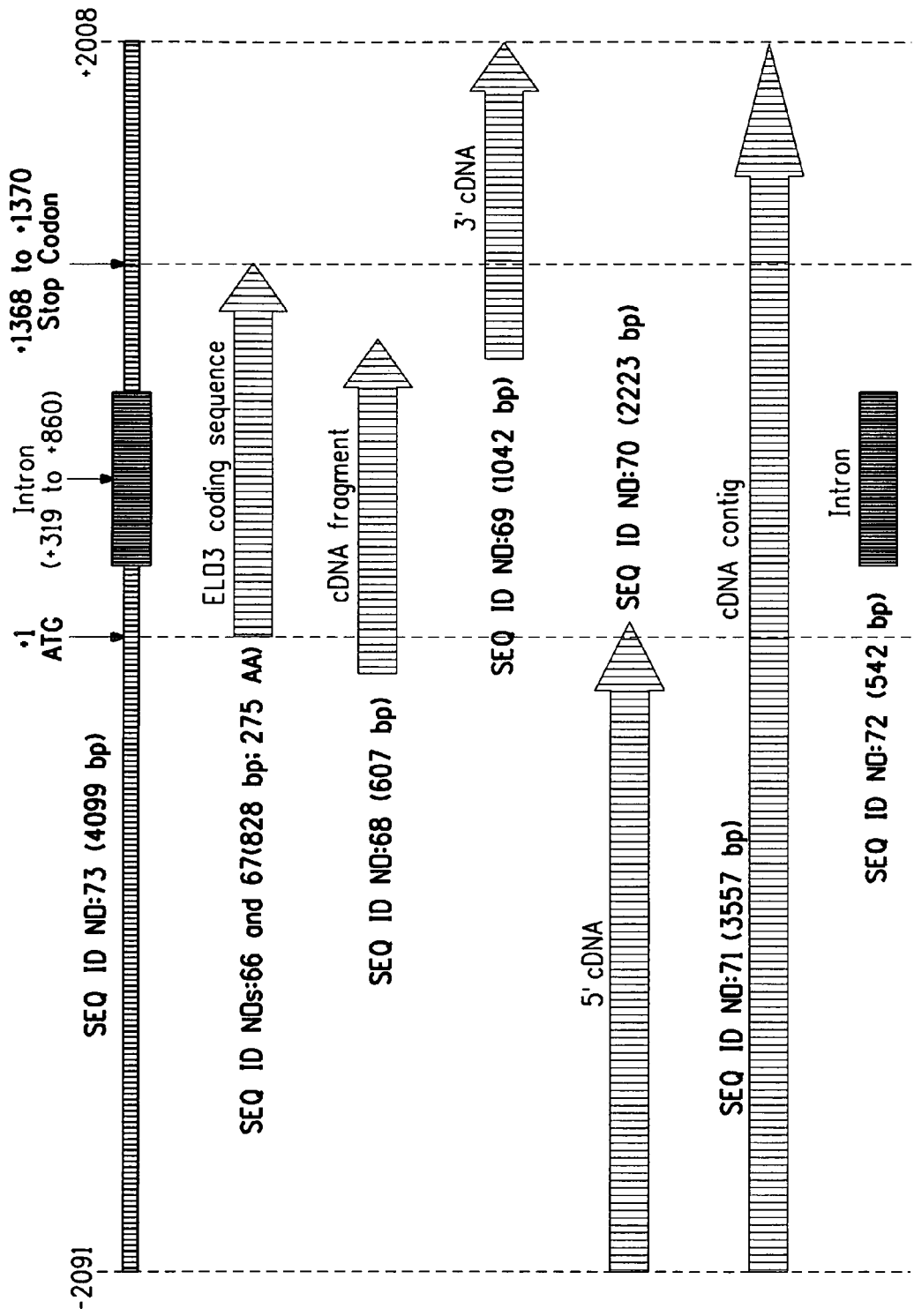

FIG. 20 graphically represents the relationship between SEQ ID NOs:66, 67, 68, 69, 70, 71, 72 and 73, each of which relates to the $C_{16/18}$ fatty acid elongase enzyme (ELO3) in Mortierella alpina.

FIG. 21 provides plasmid maps for the following: (A) pZUF6S; (B) pZUF6S-E3WT; (C) pZKUGPYE1-N; and (D) pZKUGPYE2.

FIG. 22 provides plasmid maps for the following: (A) pZKUGPYE1; (B) pZUF6FYE1; (C) pZP217+Ura; (D) pY20; and (E) pLV13.

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NOs:1-125, 173-183 and 369-389 are ORFs encoding promoters, genes or proteins (or fragments thereof) as identified in Table 1.

TABLE 1

Summary of Gene and Protein SEQ ID Numbers

| Description | Nucleic acid SEQ ID NO. | Protein SEQ ID NO. |
|---|---|---|
| Mortierella alpina Δ6 desaturase | 1 (1374 bp) | 2 (457 AA) |
| Synthetic Δ6 desaturase, derived from Mortierella alpina, codon-optimized for expression in Yarrowia lipolytica | 3 (1374 bp) | 2 (457 AA) |
| Mortierella alpina Δ6 desaturase "B" | 4 (1521 bp) | 5 (458 AA) |
| Mortierella alpina Δ5 desaturase | 6 (1341 bp) | 7 (446 AA) |
| Isochrysis galbana Δ5 desaturase | 8 (1329 bp) | 9 (442 AA) |
| Synthetic Δ5 desaturase derived from Isochrysis galbana, codon-optimized for expression in Yarrowia lipolytica | 10 (1329 bp) | 9 (442 AA) |
| Homo sapiens Δ5 desaturase | 11 (1335 bp) | 12 (444 AA) |
| Synthetic Δ5 desaturase derived from Homo sapiens, codon-optimized for expression in Yarrowia lipolytica | 13 (1335 bp) | 12 (444 AA) |
| Danio rerio Δ5/Δ6 desaturase Drd6/d5(V) (GenBank Accession No. AF309556) | 369 (1590 bp) | 370 (444 AA) |
| Danio rerio Δ5/Δ6 desaturase (GenBank Accession No. BC068224) | 371 (1946 bp) | — |
| Danio rerio Δ5/Δ6 desaturase mutant Drd6/d5(M) | 372 (1335 bp) | 373 (444 AA) |

TABLE 1-continued

Summary of Gene and Protein SEQ ID Numbers

| Description | Nucleic acid SEQ ID NO. | Protein SEQ ID NO. |
|---|---|---|
| *Saprolegnia diclina* Δ17 desaturase | 14 (1077 bp) | 15 (358 AA) |
| Synthetic Δ17 desaturase gene derived from *Saprolegnia diclina*, codon-optimized for expression in *Yarrowia lipolytica* | 16 (1077 bp) | 15 (358 AA) |
| *Mortierella alpina* C$_{18/20}$ elongase | 17 (957 bp) | 18 (318 AA) |
| Synthetic C$_{18/20}$ elongase gene derived from *Mortierella alpina*, codon-optimized for expression in *Yarrowia lipolytica* | 19 (957 bp) | 18 (318 AA) |
| *Thraustochytrium aureum* C$_{18/20}$ elongase | 20 (819 bp) | 21 (272 AA) |
| Synthetic C$_{18/20}$ elongase gene derived from *Thraustochytrium aureum*, codon-optimized for expression in *Yarrowia lipolytica* | 22 (819 bp) | 21 (272 AA) |
| *Yarrowia lipolytica* Δ12 desaturase | 23 (1936 bp) | 24 (419 AA) |
| *Mortierella isabellina* Δ12 desaturase | 25 (1203 bp) | 26 (400 AA) |
| *Fusarium moniliforme* Δ12 desaturase | 27 (1434 bp) | 28 (477 AA) |
| *Aspergillus nidulans* Δ12 desaturase | 29 (1416 bp) | 30 (471 AA) |
| *Aspergillus flavus* Δ12 desaturase | — | 31 (466 AA) |
| *Aspergillus fumigatus* Δ12 desaturase | — | 32 (424 AA) |
| *Magnaporthe grisea* Δ12 desaturase | 33 (1656 bp) | 34 (551 AA) |
| *Neurospora crassa* Δ12 desaturase | 35 (1446 bp) | 36 (481 AA) |
| *Fusarium graminearium* Δ12 desaturase | 37 (1371 bp) | 38 (456 AA) |
| *Mortierella alpina* Δ12 desaturase | 374 (1403 bp) | 375 (400 AA) |
| *Saccharomyces kluyveri* Δ12 desaturase | — | 376 (416 AA) |
| *Kluyveromyces lactis* Δ12 desaturase | 377 (1948 bp) | 378 (415 AA) |
| *Candida albicans* Δ12 desaturase | — | 379 (436 AA) |
| *Debaryomyces hansenii* CBS767 Δ12 desaturase | — | 380 (416 AA) |
| *Fusarium moniliforme* Δ15 desaturase | 39 (1209 bp) | 40 (402 AA) |
| *Aspergillus nidulans* Δ15 desaturase | 41 (1206 bp) | 42 (401 AA) |
| *Magnaporthe grisea* Δ15 desaturase | 43 (1185 bp) | 44 (394 AA) |
| *Neurospora crassa* Δ15 desaturase | 45 (1290 bp) | 46 (429 AA) |
| *Fusarium graminearium* Δ15 desaturase | 47 (1212 bp) | 48 (403 AA) |
| *Mortierella alpina* Δ15 desaturase | 381 (1353 bp) | 382 (403 AA) |
| *Kluyveromyces lactis* Δ15 desaturase | 383 (1248 bp) | 384 (415 AA) |
| *Candida albicans* Δ15 desaturase | — | 385 (433 AA) |
| *Saccharomyces kluyveri* Δ15 desaturase | — | 386 (419 AA) |
| *Debaryomyces hansenii* CBS767 Δ15 desaturase | — | 387 (435 AA) |
| *Aspergillus fumigatus* Δ15 desaturase | — | 388 (396 AA) |
| *Isochrysis galbana* Δ9 elongase | 49 (792 bp) | 50 (263 AA) |
| Synthetic Δ9 elongase gene, codon-optimized for expression in *Yarrowia lipolytica* | 51 (792 bp) | 50 (263 AA) |
| *Euglena gracillis* Δ8 desaturase gene (non-functional; GenBank Accession No. AAD45877) | 52 (1275 bp) | 53 (419 AA) |
| *Euglena gracillis* Δ8 desaturase gene (non-functional; Wallis et al. [Archives of Biochem. Biophys., 365: 307–316 (1999)]; WO 00/34439) | — | 54 (422 AA) |
| Synthetic Δ8 desaturase gene, codon-optimized for expression in *Yarrowia lipolytica* (D8S-1) | 55 (1270 bp) | — |
| Synthetic Δ8 desaturase gene, codon-optimized for expression in *Yarrowia lipolytica* (D8S-3) | 56 (1269 bp) | — |
| *Euglena gracillis* Δ8 desaturase gene (Eg5) | 57 (1271 bp) | 58 (421 AA) |
| *Euglena gracillis* Δ8 desaturase gene (Eg12) | 59 (1271 bp) | 60 (421 AA) |
| Synthetic Δ8 desaturase gene, codon-optimized for expression in *Yarrowia lipolytica* (D8SF) | 61 (1272 bp) | 62 (422 AA) |
| *Rattus norvegicus* C$_{16/18}$ elongase | 63 (2628 bp) | 64 (267 AA) |
| Synthetic C$_{16/18}$ elongase gene derived from *Rattus norvegicus*, codon-optimized for expression in *Yarrowia lipolytica* | 65 (804 bp) | 64 (267 AA) |
| *Mortierella alpina* C$_{16/18}$ elongase (ELO3) | 66 (828 bp) | 67 (275 AA) |
| *Mortierella alpina* ELO3-partial cDNA sequence | 68 (607 bp) | — |
| *Mortierella alpina* ELO3-3' sequence obtained by genome walking | 69 (1,042 bp) | — |
| *Mortierella alpina* ELO3-5' sequence obtained by genome walking | 70 (2,223 bp) | — |
| *Mortierella alpina* ELO3-cDNA contig | 71 (3,557 bp) | — |
| *Mortierella alpina* ELO3-intron | 72 (542 bp) | — |
| *Mortierella alpina* ELO3-genomic contig | 73 (4,099 bp) | — |
| *Yarrowia lipolytica* C$_{16/18}$ elongase gene | 74 (915 bp) | 75 (304 AA) |
| *Candida albicans* probable fatty acid elongase (GenBank Accession No. EAL04510) | — | 76 (353 AA) |
| *Yarrowia lipolytica* C$_{14/16}$ elongase gene | 77 (978 bp) | 78 (325 AA) |
| *Neurospora crassa* FEN1 gene (GenBank Accession No. CAD70918) | — | 79 (337 AA) |
| *Mortierella alpina* lysophosphatidic acid acyltransferase (LPAAT1) | 80 (945 bp) | 81 (314 AA) |
| *Mortierella alpina* lysophosphatidic acid acyltransferase (LPAAT2) | 82 (927 bp) | 83 (308 AA) |
| *Yarrowia lipolytica* lysophosphatidic acid acyltransferase (LPAAT1) | 84 (1549 bp) | 85 (282 AA) |
| *Yarrowia lipolytica* lysophosphatidic acid acyltransferase (LPAAT2)-genomic fragment comprising gene | 86 (1495 bp) | — |
| *Yarrowia lipolytica* lysophosphatidic acid acyltransferase (LPAAT2) | 87 (672 bp) | 88 (223 AA) |
| *Yarrowia lipolytica* phospholipid:diacylglycerol acyltransferase (PDAT) | 89 (2326 bp) | 90 (648 AA) |
| *Yarrowia lipolytica* acyl-CoA:sterol-acyltransferase (ARE2) | 91 (1632 bp) | 92 (543 AA) |
| *Caenorhabditis elegans* acyl-CoA:1-acyl lysophosphatidylcholine acyltransferase (LPCAT) | — | 93 (282 AA) |
| *Yarrowia lipolytica* diacylglycerol acyltransferase (DGAT1) | 94 (1578 bp) | 95 (526 AA) |
| *Mortierella alpina* diacylglycerol acyltransferase (DGAT1) | 96 (1578 bp) | 97 (525 AA) |
| *Neurospora crassa* diacylglycerol acyltransferase (DGAT1) | — | 98 (533 AA) |
| *Gibberella zeae* PH-1 diacylglycerol acyltransferase (DGAT1) | — | 99 (499 AA) |
| *Magnaporthe grisea* diacylglycerol acyltransferase (DGAT1) | — | 100 (503 AA) |
| *Aspergillus nidulans* diacylglycerol acyltransferase (DGAT1) | — | 101 (458 AA) |
| *Yarrowia lipolytica* diacylglycerol acyltransferase (DGAT2) | 102 (2119 bp) 104 (1380 bp) 106 (1068 bp) | 103 (514 AA) 105 (459 AA) 107 (355 AA) |
| *Mortierella alpina* diacylglycerol acyltransferase (DGAT2) | 108 (996 bp) | 109 (331 AA) |
| *Mortierella alpina* glycerol-3-phosphate acyltransferase (GPAT) | 110 (2151 bp) | 111 (716 AA) |
| *M. alpina* GPAT - partial cDNA sequence | 112 (1212 bp) | — |
| *M. alpina* GPAT - genomic fragment comprising −1050 bp to +2886 bp region | 113 (3935 bp) | — |
| *M. alpina* GPAT - 3' cDNA sequence obtained by genome walking | 114 (965 bp) | — |
| *M. alpina* GPAT - 5' sequence obtained by genome walking | 115 (1908 bp) | — |
| *M. alpina* GPAT - internal sequence obtained by genome walking | 116 (966 bp) | — |

TABLE 1-continued

Summary of Gene and Protein SEQ ID Numbers

| Description | Nucleic acid SEQ ID NO. | Protein SEQ ID NO. |
|---|---|---|
| *M. alpina* GPAT - intron #1 | 117 (275 bp) | — |
| *M. alpina* GPAT - intron #2 | 118 (255 bp) | — |
| *M. alpina* GPAT - intron #3 | 119 (83 bp) | — |
| *M. alpina* GPAT - intron #4 | 120 (99 bp) | — |
| *Yarrowia lipolytica* diacylglycerol cholinephosphotransferase (CPT1)-genomic fragment comprising gene | 121 (2133 bp) | — |
| *Yarrowia lipolytica* diacylglycerol cholinephosphotransferase (CPT1) | 122 (1185 bp) | 123 (394 AA) |
| *Saccharomyces cerevisiae* inositol phosphosphingolipid-specific phospholipase C (ISC1) | 124 (1434 bp) | 125 (477 AA) |
| *Yarrowia lipolytica* glyceraldehyde-3-phosphate dehydrogenase promoter (GPD) | 173 (971 bp) | — |
| *Yarrowia lipolytica* glyceraldehyde-3-phosphate dehydrogenase + intron promoter (GPDIN) | 174 (1174 bp) | — |
| *Yarrowia lipolytica* phosphoglycerate mutase promoter (GPM) | 175 (878 bp) | — |
| *Yarrowia lipolytica* fructose-bisphosphate aldolase promoter (FBA) | 176 (1001 bp) | — |
| *Yarrowia lipolytica* fructose-bisphosphate aldolase + intron promoter (FBAIN) | 177 (973 bp) | — |
| *Yarrowia lipolytica* fructose-bisphosphate aldolase + modified intron promoter (FBAINm) | 178 (924 bp) | — |
| *Yarrowia lipolytica* glycerol-3-phosphate acyltransferase promoter (GPAT) | 179 (1130 bp) | — |
| *Yarrowia lipolytica* ammonium transporter promoter (YAT1) | 180 (778 bp) | — |
| *Yarrowia lipolytica* translation elongation factor EF1-α promoter (TEF) | 181 (436 bp) | — |
| *Yarrowia lipolytica* chimeric GPM::FBA intron promoter (GPM::FBAIN) | 182 (1020 bp) | — |
| *Yarrowia lipolytica* chimeric GPM::GPD intron promoter (GPM::GPDIN) | 183 (1052 bp) | — |
| *Yarrowia lipolytica* export protein promoter (EXP1) | 389 (1000 bp) | — |

SEQ ID NOs:126-172 and 390-395 are plasmids as identified in Table 2.

TABLE 2

Summary of Plasmid SEQ ID Numbers

| Plasmid | Corresponding Figure | SEQ ID NO |
|---|---|---|
| pY5-30 | 7A | 126 (8,953 bp) |
| pKUNF12T6E | 9A | 128 (12,649 bp) |
| pDMW232 | 9B | 129 (10,945 bp) |
| pZP3L37 | 9C | 130 (12,690 bp) |
| pY37/F15 | 9D | 131 (8,194 bp) |
| pKO2UF2PE | 9E | 132 (10,838 bp) |
| pZKUT16 | 10A | 133 (5,833 bp) |
| pKO2UM25E | 10B | 134 (12,663 bp) |
| pDMW302T16 | 10C | 135 (14,864 bp) |
| pDMW303 | 10D | 136 (15,996 bp) |
| pDMW271 | 10E | 137 (13,034 bp) |
| pZKUGPI5S | 11A | 138 (6,912 bp) |
| pZKUGPE1S | — | 139 (6,540 bp) |
| pKO2UM26E | 11B | 140 (13,321 bp) |
| pZKUM | — | 141 (4,313 bp) |
| pKUNT2 | 11C | 142 (6,457 bp) |
| pZUF17 | 11D | 143 (8,165 bp) |
| pDMW237 | 14A | 144 (7,879 bp) |

TABLE 2-continued

Summary of Plasmid SEQ ID Numbers

| Plasmid | Corresponding Figure | SEQ ID NO |
|---|---|---|
| pY54PC | — | 145 (8,502 bp) |
| pKUNFmkF2 | 14D | 146 (7,145 bp) |
| pZF5T-PPC | 15B | 147 (5,553 bp) |
| pDMW297 | 15D | 148 (10,448 bp) |
| pZP2C16M899 | 16A | 149 (15,543 bp) |
| pDMW314 | 16B | 150 (13,295 bp) |
| pDMW325 | 16C | 151 (15,559 bp) |
| pZKSL5598 | 16D | 152 (16,325 bp) |
| pY72 | 17A | 390 (10,189 bp) |
| pY80 | 17B | 391 (12,558 bp) |
| pY79 | 17C | 392 (8,982 bp) |
| pY86 | 17D | 393 (10,424 bp) |
| pY94 | 18A | 394 (10,485 bp) |
| pY91M | 18B | 395 (8,423 bp) |
| pMLPAT-17 | — | 153 (8,015 bp) |
| pMLPAT-Int | — | 154 (8,411 bp) |
| pZUF-MOD-1 | 18C | 155 (7,323 bp) |
| pMDGAT1-17 | 18D | 156 (8,666 bp) |
| pMDGAT2-17 | — | 157 (8,084 bp) |
| pMGPAT-17 | 18E | 158 (9,239 bp) |
| pZF5T-PPC-E3 | — | 159 (5,031 bp) |
| pZUF6S | 21A | 160 (8,462 bp) |
| pZUF6S-E3WT | 21B | 161 (11,046 bp) |
| pZKUGPYE1-N | 21C | 162 (6,561 bp) |
| pZKUGPYE2 | 21D | 163 (6,498 bp) |
| pZUF6TYE2 | — | 164 (10,195 bp) |
| pZKUGPYE1 | 22A | 165 (6,561 bp) |
| pZUF6FYE1 | 22B | 166 (10,809 bp) |
| pYCPT1-17 | — | 167 (8,273 bp) |
| pZP2I7 + Ura | 22C | 168 (7,822 bp) |
| pYCPT1-ZP2I7 | — | 169 (7,930 bp) |
| pTEF::ISC1 | — | 170 (8,179 bp) |
| pY20 | 22D | 171 (8,196 bp) |
| pLV13 | 22E | 172 (5,105 bp) |

SEQ ID NO:368 corresponds to the codon-optimized translation initiation site for genes optimally expressed in *Yarrowia* sp.

SEQ ID NOs:184-197 correspond to primers YL211, YL212, YL376, YL377, YL203, YL204, GPAT-5-1, GPAT-5-2, ODMW314, YL341, ODMW320, ODMW341, 27203-F and 27203-R, respectively, used to amplify *Yarrowia lipolytica* promoter regions.

SEQ ID NOs:198-201 are the oligonucleotides YL-URA-16F, YL-URA-78R, GUS-767F and GUS-891 R, respectively, used for Real Time analysis.

SEQ ID NOs:202-217 correspond to 8 pairs of oligonucleotides which together comprise the entire codon-optimized coding region of the *I. galbana* Δ9 elongase (i.e., IL3-1A, IL3-1B, IL3-2A, IL3-2B, IL3-3A, IL3-3B, IL3-4A, IL3-4B, IL3-5A, IL3-5B, IL3-6A, IL3-6B, IL3-7A, IL3-7B, IL3-8A and IL3-8B, respectively).

SEQ ID NOs:218-221 correspond to primers IL3-1F, IL3-4R, IL3-5F and IL3-8R, respectively, used for PCR amplification during synthesis of the codon-optimized Δ9 elongase gene.

SEQ ID NO:222 is the 417 bp NcoI/PstI fragment described in pT9(14); and SEQ ID NO:223 is the 377 bp PstI/NotI fragment described in pT9(5-8).

SEQ ID NOs:224-249 correspond to 13 pairs of oligonucleotides which together comprise the entire codon-optimized coding region of the *E. gracilis* Δ8 desaturase (i.e., D8-1A, D8-1B, D8-2A, D8-2B, D8-3A, D8-3B, D8-4A, D8-4B, D8-5A, D8-5B, D8-6A, D8-6B, D8-7A, D8-7B, D8-8A, D8-8B, D8-9A, D8-9B, D8-10A, D8-10B, D8-11A, D8-11B, D8-12A, D8-12B, D8-13A and D8-13B, respectively).

SEQ ID NOs:250-257 correspond to primers D8-1F, D8-3R, D8-4F, D8-6R, D8-7F, D8-9R, D8-10F and D8-13R, respectively, used for PCR amplification during synthesis of the codon-optimized Δ8 desaturase gene.

SEQ ID NO:258 is the 309 bp Nco/BglII fragment described in pT8(1-3); SEQ ID NO:259 is the 321 bp BglII/XhoI fragment described in pT8(4-6); SEQ ID NO:260 is the 264 bp XhoI/SacI fragment described in pT8(7-9); and SEQ ID NO:261 is the 369 bp SacI/Not1 fragment described in pT8(10-13).

SEQ ID NOs:262 and 263 correspond to primers ODMW390 and ODMW391, respectively, used during synthesis of D8S-2 in pDMW255.

SEQ ID NOs:264 and 265 are the chimeric D8S-1::XPR and D8S-2::XPR genes described in Example 15.

SEQ ID NOs:266 and 267 correspond to primers ODMW392 and ODMW393, used during synthesis of D8S-3.

SEQ ID NOs:268 and 269 correspond to primers Eg5-1 and Eg3-3, respectively, used for amplification of the Δ8 desaturase from *Euglena gracilis*.

SEQ ID NOs:270-273 correspond to primers T7, M13-28Rev, Eg3-2 and Eg5-2, respectively, used for sequencing a Δ8 desaturase clone.

SEQ ID NO:274 corresponds to primer ODMW404, used for amplification of D8S-3.

SEQ ID NO:275 is a 1272 bp chimeric gene comprising D8S-3.

SEQ ID NOs:276 and 277 correspond to primers YL521 and YL522, respectively, used to create new restriction enzyme sites in a cloned D8S-3 gene.

SEQ ID NOs:278-291 correspond to primers YL525, YL526, YL527, YL528, YL529, YL530, YL531, YL532, YL533, YL534, YL535, YL536, YL537 and YL538, respectively, used in site directed mutagenesis reactions to produce D8SF.

SEQ ID NO:292 is a mutant AHAS gene comprising a W497L mutation.

SEQ ID NOs:293-295 correspond to BD-Clontech Creator Smart® cDNA library kit primers SMART IV oligonucleotide, CDSIII/3' PCR primer and 5'-PCR primer, respectively.

SEQ ID NO:296 corresponds to the M13 forward primer used for *M. alpina* cDNA library sequencing.

SEQ ID NOs:297-300 and 302-303 correspond to primers MLPAT-F, MLPAT-R, LPAT-Re-5-1, LPAT-Re-5-2, LPAT-Re-3-1 and LPAT-Re-3-2, respectively, used for cloning of the *M. alpina* LPAAT2 ORF.

SEQ ID NOs:301 and 304 correspond to a 5' (1129 bp) and 3' (938 bp) region of the *Y. lipolytica* LPMT1 ORF, respectively.

SEQ ID NOs:305 and 306 correspond to primers pzuf-mod1 and pzuf-mod2, respectively, used for creating "control" plasmid pZUF-MOD-1.

SEQ ID NOs:307 and 308 correspond to primers MACAT-F1 and MACAT-R, respectively, used for cloning of the *M. alpina* DGAT1 ORF.

SEQ ID NOs:309 and 310 correspond to primers MDGAT-F and MDGAT-R1, respectively, used for cloning of the *M. alpina* DGAT2 ORF.

SEQ ID NOs:311 and 312 correspond to primers MGPAT-N1 and MGPAT-NR5, respectively, used for degenerate PCR to amplify the *M. alpina* GPAT.

SEQ ID NOs:313-315 correspond to primers MGPAT-5N1, MGPAT-5N2 and MGPAT-5N3, respectively, used for amplification of the 3'-end of the *M. alpina* GPAT.

SEQ ID NOs:316 and 317 correspond to the Genome Walker adaptor from ClonTech's Universal GenomeWalker™ Kit, used for genome-walking.

SEQ ID NOs:318-321 correspond to the PCR primers used in genome-walking: MGPAT-5-1A, Adaptor-1 (AP1), MGPAT-3N1 and Nested Adaptor Primer 2 (AP2), respectively.

SEQ ID NOs:322 and 323 correspond to primers mgpat-cdna-5 and mgpat-cdna-R, respectively, used for amplifying the *M. alpina* GPAT.

SEQ ID NOs:324 and 325 correspond to primers MA Elong 3'1 and MA elong 3'2, respectively, used for genome-walking to isolate the 3'-end region of the *M. alpina* ELO3.

SEQ ID NOs:326 and 327 correspond to primers MA Elong 5'1 and MA Elong 5'2, respectively, used for genome-walking to isolate the 5'-end region of the *M. alpina* ELO3.

SEQ ID NOs:328 and 329 correspond to primers MA ELONG 5' NcoI 3 and MA ELONG 3' NotI 1, respectively, used for amplifying the complete ELO3 from *M. alpina* cDNA.

SEQ ID NOs:330 and 331 correspond to primers YL597 and YL598, respectively, used for amplifying the coding region of *Y. lipolytica* YE2.

SEQ ID NOs:332-335 correspond to primers YL567, YL568, YL569 and YL570, respectively, used for amplifying the coding region of *Y. lipolytica* YE1.

SEQ ID NOs:336 and 337 correspond to primers YL571 and YL572, respectively, used for site-directed mutagenesis during cloning of *Y. lipolytica* YE1.

SEQ ID NOs:338 and 339 correspond to primers CPT1-5'-NcoI and CPT1-3'-NotI, respectively, used for cloning of the *Y. lipolytica* CPT1 ORF.

SEQ ID NOs:340 and 341 correspond to primers Isc1F and Isc1R, respectively, used for cloning of the *S. cerevisiae* ISC1 ORF.

SEQ ID NOs:342 and 343 correspond to primers Pcl1F and Pcl1R, respectively, used for cloning of the *S. cerevisiae* PCL1 ORF.

SEQ ID NOs:344-347 correspond to primers P95, P96, P97 and P98, respectively, used for targeted disruption of the *Y. lipolytica* DGAT2 gene.

SEQ ID NOs:348-350 correspond to primers P115, P116 and P112, respectively, used to screen for targeted integration of the disrupted *Y. lipolytica* DGAT2 gene.

SEQ ID NOs:351-354 correspond to primers P39, P41, P40 and P42, respectively, used for targeted disruption of the *Y. lipolytica* PDAT gene.

SEQ ID NOs:355-358 correspond to primers P51, P52, P37 and P38, respectively, used to screen for targeted integration of the disrupted *Y. lipolytica* PDAT gene.

SEQ ID NOs:359 and 360 are the degenerate primers identified as P201 and P203, respectively, used for the isolation of the *Y. lipolytica* DGAT1.

SEQ ID NOs:361-365 correspond to primers P214, P215, P216, P217 and P219, respectively, used for the creation of a targeting cassette for targeted disruption of the putative DGAT1 gene in *Y. lipolytica*.

SEQ ID NOs:366 and 367 correspond to primers P226 and P227, respectively, used to screen for targeted integration of the disrupted *Y. lipolytica* DGAT1 gene.

SEQ ID NOs:396-401 correspond to primers 410, 411, 412, 413, 414 and 415, respectively, used for synthesis of a mutant *Yarrowia lipolytica* AHAS gene, comprising a W497L mutation.

SEQ ID NOs:402 and 403 correspond to primers YL325 and YL326, respectively, used to amplify a NotI/PacI fragment containing the Aco 3' terminator.

SEQ ID NO:404 corresponds to a His Box 1 motif found in fungal Δ15 and Δ12 desaturases.

SEQ ID NO:405 corresponds to a motif that is indicative of a fungal protein having Δ15 desaturase activity, while SEQ ID NO:406 corresponds to a motif that is indicative of a fungal protein having Δ12 desaturase activity.

SEQ ID NO:407 corresponds to a LoxP recombination site that is recognized by the Cre recombinase enzyme.

SEQ ID NOs:408 and 409 correspond to primers 436 and 437, respectively, used to amplify a GPD::Fm1::XPR2 during synthesis of plasmid pY80.

SEQ ID NOs:410-413 correspond to primers 475, 477, 478 and 476, respectively, used to clone a bifunctional Δ5/Δ6 desaturase.

SEQ ID NOs:414 and 127 correspond to primers 505 and 506, respectively, used to created plasmid pY91V from plasmid pY91M by site-specific mutagenesis.

DETAILED DESCRIPTION OF THE INVENTION

All patents, patent applications, and publications cited herein are incorporated by reference in their entirety. This specifically includes, the following Applicants' Assignee's copending applications:

U.S. patent application Ser. No. 10/840,478 (filed May 6, 2004),

U.S. patent application Ser. No. 10/840,579 (filed May 6, 2004),

U.S. patent application Ser. No. 10/840,325 (filed May 6, 2004)

U.S. patent application Ser. No. 10/869,630 (filed Jun. 16, 2004),

U.S. patent application Ser. No. 10/882,760 (filed Jul. 1, 2004),

U.S. patent application Ser. No. 10/985,109 (filed Nov. 10, 2004),

U.S. patent application Ser. No. 10/987,548 (filed Nov. 12, 2004)

U.S. Patent Application No. 60/624,812 (filed Nov. 4, 2004),

U.S. patent applications Ser. No. 11/024,545 and No. 11/024,544 (filed Dec. 29, 2004), U.S. Patent Application No. 60/689,031 (filed Jun. 9, 2005), U.S. patent application Ser. No. 11/183,664 (filed Jul. 18, 2005), U.S. patent application Ser. No. 11/185,301 (filed Jul. 20, 2005), U.S. patent application Ser. No. 11/190,750 (filed Jul. 27, 2005), U.S. patent application Ser. No. 11/225,354 (filed Sep. 13, 2005), U.S. patent application Ser. No. 10/253,882 (filed Oct. 19, 2005) and U.S. patent application Ser. No. 11/254,173 (filed Oct. 19, 2005).

In accordance with the subject invention, Applicants provide production host strains of *Yarrowia lipolytica* that are capable of producing greater than 25% eicosapentaenoic acid (EPA, 20:5, ω-3). Accumulation of this particular polyunsaturated fatty acid (PUFA) is accomplished by introduction of either of two different functional ω-3/ω-6 fatty acid biosynthetic pathways. The first pathway comprises proteins with Δ6 desaturase, $C_{18/20}$ elongase, Δ5 desaturase and either Δ17 desaturase or Δ15 desaturase activities into the oleaginous yeast host for high-level recombinant expression, wherein the EPA oil also comprises GLA; the latter pathway comprises proteins with Δ9 elongase, Δ8 desaturase, Δ5 desaturase and either Δ17 desaturase or Δ15 desaturase activities and thereby enables production of an EPA oil that is devoid of any GLA. Thus, this disclosure demonstrates that *Y. lipolytica* can be engineered to enable commercial production of EPA and derivatives thereof. Methods of production are also claimed.

The subject invention finds many applications. PUFAs, or derivatives thereof, made by the methodology disclosed herein can be used as dietary substitutes, or supplements, particularly infant formulas, for patients undergoing intravenous feeding or for preventing or treating malnutrition. Alternatively, the purified PUFAs (or derivatives thereof) may be incorporated into cooking oils, fats or margarines formulated so that in normal use the recipient would receive the desired amount for dietary supplementation. The PUFAs may also be incorporated into infant formulas, nutritional supplements or other food products and may find use as anti-inflammatory or cholesterol lowering agents. Optionally, the compositions may be used for pharmaceutical use (human or veterinary). In this case, the PUFAs are generally administered orally but can be administered by any route by which they may be successfully absorbed, e.g., parenterally (e.g., subcutaneously, intramuscularly or intravenously), rectally, vaginally or topically (e.g., as a skin ointment or lotion).

Supplementation of humans or animals with PUFAs produced by recombinant means can result in increased levels of the added PUFAs, as well as their metabolic progeny. For example, treatment with EPA can result not only in increased levels of EPA, but also downstream products of EPA such as eicosanoids (i.e., prostaglandins, leukotrienes, thromboxanes). Complex regulatory mechanisms can make it desirable to combine various PUFAs, or add different conjugates of PUFAs, in order to prevent, control or overcome such mechanisms to achieve the desired levels of specific PUFAs in an individual.

In alternate embodiments, PUFAs, or derivatives thereof, made by the methodology disclosed herein can be utilized in the synthesis of aquaculture feeds (i.e., dry feeds, semi-moist and wet feeds) since these formulations generally require at least 1-2% of the nutrient composition to be ω-3 and/or ω-6 PUFAs.

Definitions

In this disclosure, a number of terms and abbreviations are used. The following definitions are provided.

"Open reading frame" is abbreviated ORF.

"Polymerase chain reaction" is abbreviated PCR.

"American Type Culture Collection" is abbreviated ATCC.

"Polyunsaturated fatty acid(s)" is abbreviated PUFA(s).

"Diacylglycerol acyltransferase" is abbreviated DAG AT or DGAT.

"Phospholipid:diacylglycerol acyltransferase" is abbreviated PDAT.

"Glycerol-3-phosphate acyltransferase" is abbreviated GPAT.

"Lysophosphatidic acid acyltransferase" is abbreviated LPAAT.

"Acyl-CoA: 1-acyl lysophosphatidylcholine acyltransferase" is abbreviated "LPCAT".

"Acyl-CoA:sterol-acyltransferase" is abbreviated ARE2.

"Diacylglycerol" is abbreviated DAG.

"Triacylglycerols" are abbreviated TAGs.

"Co-enzyme A" is abbreviated CoA.

"Phosphatidyl-choline" is abbreviated PC.

The term "*Fusarium moniliforme*" is synonymous with "*Fusarium verticillioides*".

The term "food product" refers to any food generally suitable for human consumption. Typical food products include but are not limited to meat products, cereal products, baked foods, snack foods, dairy products and the like.

The term "functional food" refers to those foods that encompass potentially healthful products including any modified food or ingredient that may provide a health benefit beyond the traditional nutrients it contains. Functional foods can include foods like cereals, breads and beverages which are fortified with vitamins, herbs and nutraceuticals. Functional foods contain a substance that provides health benefits beyond its nutritional value, wherein the substance either is naturally present in the food or is deliberately added.

As used herein the term "medical food" refers to a food which is formulated to be consumed or administered enterally under the supervision of a physician and which is intended for the specific dietary management of a disease or condition for which distinctive nutritional requirements, based on recognized scientific principles, are established by medical evaluation [see section 5(b) of the Orphan Drug Act (21 U.S.C. 360ee(b)(3))]. A food is a "medical food" only if: (i) It is a specially formulated and processed product (as opposed to a naturally occurring foodstuff used in its natural state) for the partial or exclusive feeding of a patient by means of oral intake or enteral feeding by tube; (ii) It is intended for the dietary management of a patient who, because of therapeutic or chronic medical needs, has limited or impaired capacity to ingest, digest, absorb, or metabolize ordinary foodstuffs or certain nutrients, or who has other special medically determined nutrient requirements, the dietary management of which cannot be achieved by the modification of the normal diet alone; (iii) It provides nutritional support specifically modified for the management of the unique nutrient needs that result from the specific disease or condition, as determined by medical evaluation; (iv) It is intended to be used under medical supervision; and (v) It is intended only for a patient receiving active and ongoing medical supervision wherein the patient requires medical care on a recurring basis for, among other things, instructions on the use of the medical food. Thus, unlike dietary supplements or conventional foods, a medical food that is intended for the specific dietary management of a disease or condition for which distinctive nutritional requirements have been established, may bear scientifically valid claims relating to providing distinctive nutritional support for a specific disease or condition. Medical foods are distinguished from the broader category of foods for special dietary use (e.g., hypoallergenic foods) and from foods that make health claims (e.g., dietary supplements) by the requirement that medical foods be used under medical supervision.

The term "medical nutritional" is a medical food as defined herein typically refers to a fortified beverage that is specifically designed for special dietary needs. The medical nutritional generally comprises a dietary composition focused at a specific medical or dietary condition. Examples of commercial medical nuturitionals include, but are not limited to Ensure® and Boost®.

The term "pharmaceutical" as used herein means a compound or substance which if sold in the United States would be controlled by Section 505 or 505 of the Federal Food, Drug and Cosmetic Act.

The term "infant formula" means a food which is designed exclusively for consumption by the human infant by reason of its simulation of human breast milk. Typical commercial examples of infant formula include bur are not limited to Similac®, and Isomil®.

The term "dietary supplement" refers to a product that: (i) is intended to supplement the diet and thus is not represented for use as a conventional food or as a sole item of a meal or the diet; (ii) contains one or more dietary ingredients (including, e.g., vitamins, minerals, herbs or other botanicals, amino acids, enzymes and glandulars) or their constituents; (iii) is intended to be taken by mouth as a pill, capsule, tablet, or liquid; and (iv) is labeled as being a dietary supplement.

The term "clinical condition" will mean a condition in a human or animal this is impairs the health and well being of the human or animal and can be remediated by the supplementation of PUFA's and particularly w-3 and w-6 fatty acids. Clinical conditions may take the form of well documented disease states such as coronary heart disease or a general condition of poor health brought about by poor nutrient regulation.

A "food analog" is a food-like product manufactured to resemble its food counterpart, whether meat, cheese, milk or the like, and is intended to have the appearance, taste, and texture of its counterpart. Thus, the term "food" as used herein also encompasses food analogs.

The terms "aquaculture feed" and "aquafeed" refer to manufactured or artificial diets (formulated feeds) to supplement or to replace natural feeds in the aquaculture industry. Thus, an aquafeed refers to artificially compounded feeds that are useful for farmed finfish and crustaceans (i.e., both lower-value staple food fish species [e.g., freshwater finfish such as carp, tilapia and catfish] and higher-value cash crop species for luxury or niche markets [e.g., mainly marine and diadromous species such as shrimp, salmon, trout, yellowtail, seabass, seabream and grouper]). These formulate feeds are composed of several ingredients in various proportions complementing each other to form a nutritionally complete diet for the aquacultured species.

The term "animal feed" refers to feeds intended exclusively for consumption by animals, including domestic animals (pets, farm animals etc.) or for animals raised for the production of food e.g. fish farming.

The term "feed nutrient" means nutrients such as proteins, lipids, carbohydrates, vitamins, minerals, and nucleic acids that may be derived from the yeast biomass comprising the recombinant production hosts of the invention.

As used herein the term "biomass" refers specifically to spent or used yeast cellular material from the fermentation of a recombinant production host production EPA in commercially significant amounts.

The term "fatty acids" refers to long chain aliphatic acids (alkanoic acids) of varying chain lengths, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" (or "PUFAs"), and "omega-6 fatty acids" (ω-6 or n-6) versus "omega-3 fatty acids" (ω-3 or n-3) are provided in WO2004/101757.

Nomenclature used to describe PUFAs in the present disclosure is shown below in Table 3. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the Table summarizes the common names of ω-3 and ω-6 fatty acids and their precursors, the abbreviations that will be used throughout the specification and each compounds' chemical name.

TABLE 3

Nomenclature of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω-6 |
| γ-Linoleic | GLA | cis-6,9,12-octadecatrienoic | 18:3 ω-6 |
| Eicosadienoic | EDA | cis-11,14-eicosadienoic | 20:2 ω-6 |
| Dihomo-γ-Linoleic | DGLA | cis-8,11,14-eicosatrienoic | 20:3 ω-6 |
| Arachidonic | ARA | cis-5,8,11,14-eicosatetraenoic | 20:4 ω-6 |
| α-Linolenic | ALA | cis-9,12,15-octadecatrienoic | 18:3 ω-3 |
| Stearidonic | STA | cis-6,9,12,15-octadecatetraenoic | 18:4 ω-3 |
| Eicosatrienoic | ETrA | cis-11,14,17-eicosatrienoic | 20:3 ω-3 |
| Eicosatetraenoic | ETA | cis-8,11,14,17-eicosatetraenoic | 20:4 ω-3 |
| Eicosapentaenoic | EPA | cis-5,8,11,14,17-eicosapentaenoic | 20:5 ω-3 |
| Docosapentaenoic | DPA | cis-7,10,13,16,19-docosapentaenoic | 22:5 ω-3 |
| Docosahexaenoic | DHA | cis-4,7,10,13,16,19-docosahexaenoic | 22:6 ω-3 |

The term "high-level EPA production" refers to production of at least about 5% EPA in the total lipids of the microbial host, preferably at least about 10% EPA in the total lipids, more preferably at least about 15% EPA in the total lipids, more preferably at least about 20% EPA in the total lipids, more preferably at least about 25-30% EPA in the total lipids, more preferably at least about 30-35% EPA in the total lipids, more preferably at least about 35-40%, and most most preferably at least about 40-50% EPA in the total lipids. The structural form of the EPA is not limiting; thus, for example, the EPA may exist in the total lipids as free fatty acids or in esterified forms such as acylglycerols, phospholipids, sulfolipids or glycolipids The term "devoid of any GLA" refers to lack of any detectable GLA in the total lipids of the microbial host, when measured by GC analysis using equipment having a detectable level down to about 0.1%.

The term "essential fatty acid" refers to a particular PUFA that an organism must ingest in order to survive, being unable to synthesize the particular essential fatty acid de novo. For example, mammals can not synthesize the essential fatty acids LA (18:2, ω-6) and ALA (18:3, ω-3). Other essential fatty acids include GLA (ω-6), DGLA (ω-6), ARA (ω-6), EPA ((ω-3) and DHA (ω-3).

"Microbial oils" or "single cell oils" are those oils naturally produced by microorganisms (e.g., algae, oleaginous yeasts and filamentous fungi) during their lifespan. The term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes and, their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydolysis reaction must occur to release free fatty acids from acylglycerols.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

The term "acyltransferase" refers to an enzyme responsible for transferring a group other than an amino-acyl group (EC 2.3.1.-).

The term "DAG AT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1,2-diacylglycerol to TAG and CoA (thereby involved in the terminal step of TAG biosynthesis). Two families of DAG AT enzymes exist: DGAT1 and DGAT2. The former family shares homology with the acyl-CoA:cholesterol acyltransferase (ACAT) gene family, while the latter family is unrelated (Lardizabal et al., *J. Biol. Chem.* 276(42):38862-38869 (2001)).

The term "PDAT" refers to a phospholipid:diacylglycerol acyltransferase enzyme (EC 2.3.1.158). This enzyme is responsible for the transfer of an acyl group from the sn-2 position of a phospholipid to the sn-3 position of 1,2-diacylglycerol, thus resulting in lysophospholipid and TAG (thereby involved in the terminal step of TAG biosynthesis). This enzyme differs from DGAT (EC 2.3.1.20) by synthesizing TAG via an acyl-CoA-independent mechanism.

The term "ARE2" refers to an acyl-CoA:sterol-acyltransferase enzyme (EC 2.3.1.26; also known as a sterol-ester synthase 2 enzyme), catalyzing the following reaction: acyl-CoA+sterol=CoA+sterol ester.

The term "GPAT" refers to a glycerol-3-phosphate O-acyltransferase enzyme (E.C. 2.3.1.15) encoded by the gpat gene and which converts acyl-CoA and sn-glycerol 3-phosphate to CoA and 1-acyl-sn-glycerol 3-phosphate (the first step of phospholipid biosynthesis).

The term "LPAAT" refers to a lysophosphatidic acid-acyltransferase enzyme (EC 2.3.1.51). This enzyme is responsible for the transfer of an acyl-CoA group onto 1-acyl-sn-glycerol 3-phosphate (i.e., lysophosphatidic acid) to produce CoA and 1,2-diacyl-sn-glycerol 3-phosphate (phosphatidic acid). The literature also refers to LPAAT as acyl-CoA:1-acyl-sn-glycerol-3-phosphate 2-O-acyltransferase, 1-acyl-sn-glycerol-3-phosphate acyltransferase and/or 1-acylglycerolphosphate acyltransferase (abbreviated as AGAT).

The term "LPCAT" refers to an acyl-CoA:1-acyl lysophosphatidyl-choline acyltransferase. This enzyme is responsible for the exchange of acyl groups between CoA and phosphatidyl choline (PC). Herein it also refers to enzymes involved the acyl exchange between CoA and other phospholipids, including lysophosphatidic acid (LPA).

"Percent (%) PUFAs in the total lipid and oil fractions" refers to the percent of PUFAs relative to the total fatty acids in those fractions. The term "total lipid fraction" or "lipid fraction" both refer to the sum of all lipids (i.e., neutral and polar) within an oleaginous organism, thus including those lipids that are located in the phosphatidylcholine (PC) fraction, phosphatidyletanolamine (PE) fraction and triacylglycerol (TAG or oil) fraction. However, the terms "lipid" and "oil" will be used interchangeably throughout the specification.

The term "phosphatidylcholine" or "PC" refers to a phospholipid that is a major constituent of cell membranes. The chemical structure of PC can generally be described as comprising the following: a choline molecule, a phosphate group and glycerol, wherein fatty acyl chains are attached as R groups on the sn-1 and sn-2 positions of the glycerol molecule.

The term "PUFA biosynthetic pathway enzyme" refers to any of the following enzymes (and genes which encode said enzymes) associated with the biosynthesis of a PUFA, including: a Δ4 desaturase, a Δ5 desaturase, a Δ6 desaturase, a Δ12 desaturase, a Δ15 desaturase, a Δ17 desaturase, a Δ9 desaturase, a Δ8 desaturase, a Δ9 elongase, a $C_{14/16}$ elongase, a $C_{16/18}$ elongase, a $C_{18/20}$ elongase and/or a $C_{20/22}$ elongase.

Figure 1:
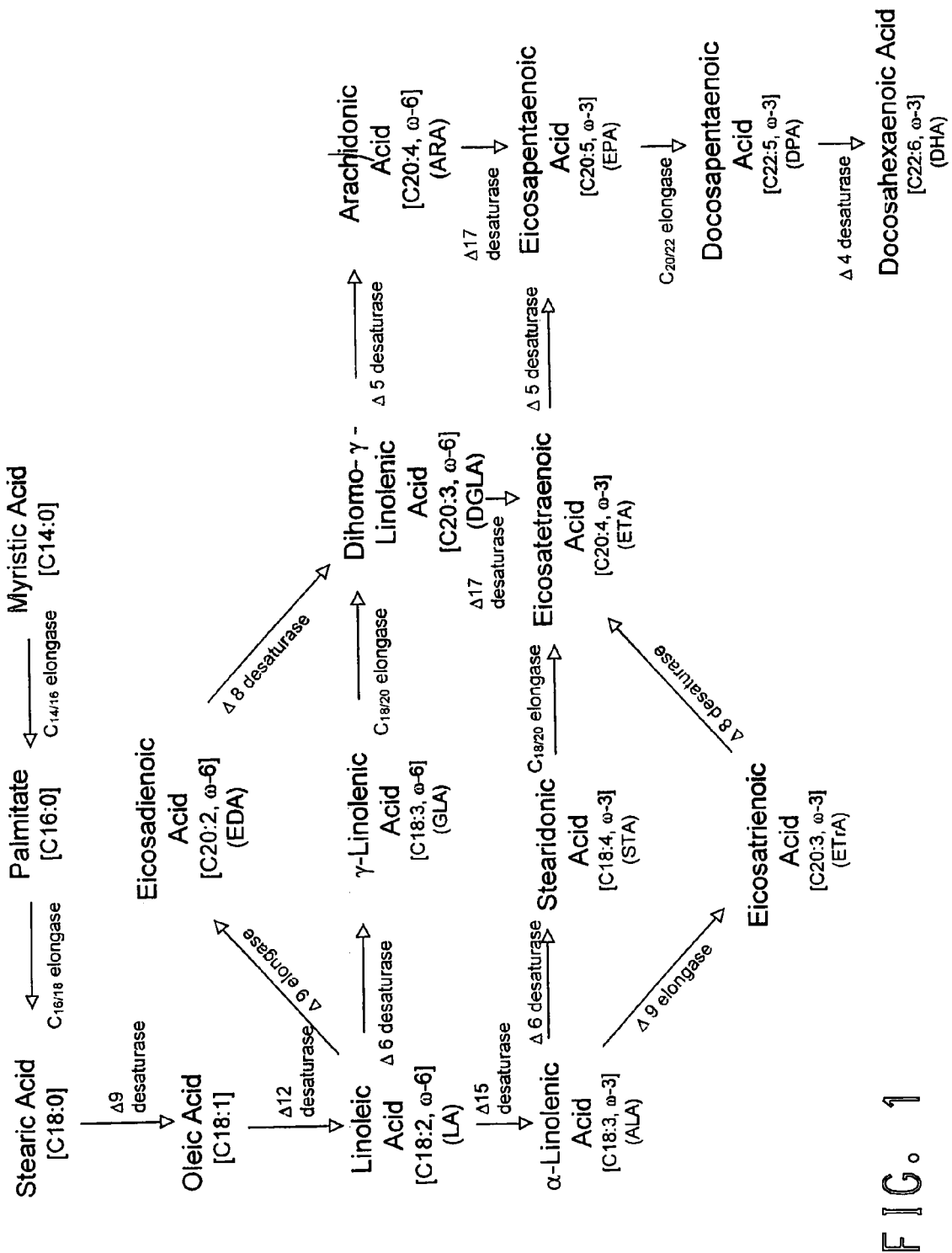
FIG. 1 illustrates the ω-3/ω-6 fatty acid biosynthetic pathway.

The term "ω-3/ω-6 fatty acid biosynthetic pathway" refers to a set of genes which, when expressed under the appropriate conditions encode enzymes that catalyze the production of either or both ω-3 and ω-6 fatty acids. Typically the genes involved in the ω-3/ω-6 fatty acid biosynthetic pathway encode some or all of the following enzymes: Δ12 desaturase, Δ6 desaturase, $C_{18/20}$ elongase, $C_{20/22}$ elongase, Δ5 desaturase, Δ17 desaturase, Δ15 desaturase, Δ9 desaturase, Δ8 desaturase, a Δ9 elongase and Δ4 desaturase. A representative pathway is illustrated in FIG. 1, providing for the conversion of oleic acid through various intermediates to DHA, which demonstrates how both ω-3 and ω-6 fatty acids may be produced from a common source. The pathway is naturally divided into two portions where one portion will generate ω-3 fatty acids and the other portion, only ω-6 fatty acids. That portion that only generates ω-3 fatty acids will be referred to herein as the ω-3 fatty acid biosynthetic pathway, whereas that portion that generates only ω-6 fatty acids will be referred to herein as the ω-6 fatty acid biosynthetic pathway.

The term "functional" as used herein in context with the ω-3/ω-6 fatty acid biosynthetic pathway means that some (or all of) the genes in the pathway express active enzymes, resulting in in vivo catalysis or substrate conversion. It should be understood that "ω-3/ω-6 fatty acid biosynthetic pathway" or "functional ω-3/ω-6 fatty acid biosynthetic pathway" does not imply that all the genes listed in the above paragraph are required, as a number of fatty acid products will only require the expression of a subset of the genes of this pathway.

The term "ω-6 Δ6 desaturase/Δ6 elongase pathway" will refer to an EPA fatty acid biosynthetic pathway that minimally includes the following genes: Δ6 desaturase, $C_{18/20}$ elongase, Δ5 desaturase and Δ17 desaturase. The term "ω-3 Δ6 desaturase/Δ6 elongase pathway" will refer to an EPA fatty acid biosynthetic pathway that minimally includes the following genes: Δ15 desaturase, Δ6 desaturase, $C_{18/20}$ elongase and Δ5 desaturase. The term "combination Δ6 desaturase/Δ6 elongase pathway" will refer to an EPA fatty acid biosynthetic pathway that minimally includes the following genes: Δ15 desaturase, Δ6 desaturase, $C_{18/20}$ elongase, Δ5 desaturase and Δ17 desaturase. Finally, the term "Δ6 desaturase/Δ6 elongase pathway" will generically refer to any one (or more) of the Δ6 desaturase/Δ6 elongase pathways described above.

In a related manner, the term "ω-6 Δ9 elongase/Δ8 desaturase pathway" will refer to an EPA fatty acid biosynthetic pathway that minimally includes the following genes: Δ9 elongase, Δ8 desaturase, Δ5 desaturase and Δ17 desaturase. The term "ω-3 Δ9 elongase/Δ8 desaturase pathway" will refer to an EPA fatty acid biosynthetic pathway that minimally includes the following genes: Δ15 desaturase, Δ9 elongase, Δ8 desaturase and Δ5 desaturase. The term "combination Δ9 elongase/Δ8 desaturase pathway" will refer to an EPA fatty acid biosynthetic pathway that minimally includes the following genes: Δ15 desaturase, Δ9 elongase, Δ8 desaturase, Δ5 desaturase and Δ17 desaturase. The term "Δ9 elongase/Δ8 desaturase pathway" will generically refer to any one (or more) of the Δ9 elongase/Δ8 desaturase pathways described above.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: 1.) Δ17 desaturases that desaturate a fatty acid between the $17^{th}$ and $18^{th}$ carbon atom numbered from the carboxyl-terminal end of the molecule and which, for example, catalyze the conversion of ARA to EPA and/or DGLA to ETA; 2.) Δ6 desaturases that catalyze the conversion of LA to GLA and/or ALA to STA; 3.) Δ5 desaturases that catalyze the conversion of DGLA to ARA and/or ETA to EPA; 4.) Δ4 desaturases that catalyze the conversion of DPA to DHA; 5.) Δ12 desaturases that catalyze the conversion of oleic acid to LA; 6.) Δ15 desaturases that catalyze the conversion of LA to ALA and/or GLA to STA; 7.) Δ8 desaturases that catalyze the conversion of EDA to DGLA and/or ETrA to ETA; and 8.) Δ9 desaturases that catalyze the conversion of palmitate to palmitoleic acid (16:1) and/or stearate to oleic acid (18:1).

The term "bifunctional" as it refers to Δ15 desaturases of the invention means that the polypeptide has the ability to use both oleic acid and LA as an enzymatic substrate. Similarly, the term "bifunctional" as it refers to Δ5 desaturases of the invention means that the polypeptide has the ability to use: (1) at least one enzymatic substrate selected from the group consisting of DGLA and ETA; and (2) at least one enzymatic substrate selected from the group consisting of LA and ALA. By "enzymatic substrate" it is meant that the polypeptide binds the substrate at an active site and acts upon it in a reactive manner.

The term "elongase system" refers to a suite of four enzymes that are responsible for elongation of a fatty acid carbon chain to produce a fatty acid that is 2 carbons longer than the fatty acid substrate that the elongase system acts upon. More specifically, the process of elongation occurs in association with fatty acid synthase, whereby CoA is the acyl carrier (Lassner et al., *The Plant Cell* 8:281-292 (1996)). In the first step, which has been found to be both substrate-specific and also rate-limiting, malonyl-CoA is condensed with a long-chain acyl-CoA to yield $CO_2$ and a β-ketoacyl-CoA (where the acyl moiety has been elongated by two carbon atoms). Subsequent reactions include reduction to β-hydroxyacyl-CoA, dehydration to an enoyl-CoA and a second reduction to yield the elongated acyl-CoA. Examples of reactions catalyzed by elongase systems are the conversion of GLA to DGLA, STA to ETA and EPA to DPA.

For the purposes herein, an enzyme catalyzing the first condensation reaction (i.e., conversion of malonyl-CoA to β-ketoacyl-CoA) will be referred to generically as an "elongase". In general, the substrate selectivity of elongases is somewhat broad but segregated by both chain length and the degree and type of unsaturation. Accordingly, elongases can have different specificities. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase will utilize a $C_{18}$ substrate (e.g., GLA, STA) and a $C_{20/22}$ elongase will utilize a $C_{20}$ substrate (e.g., EPA). In like manner, a Δ9 elongase is able to catalyze the conversion of LA and ALA to EDA and ETrA, respectively. It is important to note that some elongases have broad specificity and thus a single enzyme may be capable of catalyzing several elongase reactions (e.g., thereby acting as both a $C_{16/18}$ elongase and a $C_{18/20}$ elongase). In preferred embodiments, it is most desirable to empirically determine the specificity of a fatty acid elongase by transforming a suitable host with the gene for the fatty acid elongase and determining its effect on the fatty acid profile of the host.

The term "high affinity elongase" or "EL1S" or "ELO1" refers to a $C_{18/20}$ elongase whose substrate specificity is preferably for GLA (with DGLA as a product of the elongase reaction [i.e., a Δ6 elongase]). One such elongase is described in WO 00/12720 and is provided herein as SEQ ID NOs:17 and 18. However, the Applicants have shown that this enzyme also has some activity on 18:2 (LA) and 18:3 (ALA). Thus, SEQ ID NO:18 shows Δ9 elongase activity (in addition to its Δ6 elongase activity). It is therefore concluded that the $C_{18/20}$ elongase provided herein as SEQ ID NO:18 can function both within the Δ6 desaturase/Δ6 elongase pathway as described in the invention herein and within the Δ9 elongase/Δ8 desaturase pathway, as a substitute for e.g., the *Isochrysis galbana* Δ9 elongase (SEQ ID NO:50).

The term "EL2S" or "ELO2" refers to a $C_{18/20}$ elongase whose substrate specificity is preferably for GLA (with DGLA as a product of the elongase reaction) and/or STA (with STA as a product of the elongase reaction). One such elongase is described in U.S. Pat. No. 6,677,145 and is provided herein as SEQ ID NOs:20 and 21.

The term "ELO3" refers to a *Mortierella alpina* $C_{16/18}$ fatty acid elongase enzyme (provided herein as SEQ ID NO:67), encoded by the elo3 gene (SEQ ID NO:66). The term "YE2" refers to a *Yarrowia lipolytica* $C_{16/18}$ fatty acid elongase enzyme (provided herein as SEQ ID NO:75), encoded by the gene provided herein as SEQ ID NO:74. Based on data reported herein, both ELO3 amd YE2 preferentially catalyze the conversion of palmitate (16:0) to stearic acid (18:0).

The term "YE1" refers to a *Yarrowia lipolytica* $C_{14/16}$ fatty acid elongase enzyme (provided herein as SEQ ID NO:78), encoded by the gene provided herein as SEQ ID NO:77. Based on data reported herein, YE2 preferentially catalyzes the conversion of myristic acid (14:0) to palmitate (16:0).

The terms "conversion efficiency" and "percent substrate conversion" refer to the efficiency by which a particular enzyme (e.g., a desaturase or elongase) can convert substrate to product. The conversion efficiency is measured according to the following formula: ([product]/[substrate+product])*100, where 'product' includes the immediate product and all products in the pathway derived from it.

The term "oleaginous" refers to those organisms that tend to store their energy source in the form of lipid (Weete, In: Fungal Lipid Biochemistry, $2^{nd}$ Ed., Plenum, 1980). Generally, the cellular oil content of these microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)).

The term "oleaginous yeast" refers to those microorganisms classified as yeasts that can make oil. Generally, the cellular oil or triacylglycerol content of oleaginous microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)). It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "fermentable carbon source" means a carbon source that a microorganism will metabolize to derive energy. Typical carbon sources of the invention include, but are not limited to: monosaccharides, oligosaccharides, polysaccharides, alkanes, fatty acids, esters of fatty acids, monoglycerides, diglycerides, triglycerides, carbon dioxide, methanol, formaldehyde, formate and carbon-containing amines.

As used herein, an "isolated nucleic acid fragment" is a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Basic Local Alignment Search Tool; Altschul, S. F., et al., *J. Mol. Biol.* 215:403-410 (1993)). In general, a sequence of ten or more contiguous amino acids or thirty or more nucleotides is necessary in order to identify putatively a polypeptide or nucleic acid sequence as homologous to a known protein or gene. Moreover, with respect to nucleotide sequences, gene-specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence.

The term "complementary" is used to describe the relationship between nucleotide bases that are capable of hybridizing to one another. For example, with respect to DNA, adenosine is complementary to thymine and cytosine is complementary to guanine.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Chemically synthesized", as related to a sequence of DNA, means that the component nucleotides were assembled in vitro. Manual chemical synthesis of DNA may be accomplished using well-established procedures or, automated chemical synthesis can be performed using one of a number of commercially available machines. "Synthetic genes" can be assembled from oligonucleotide building blocks that are chemically synthesized using procedures known to those skilled in the art. These building blocks are ligated and annealed to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available.

"Gene" refers to a nucleic acid fragment that expresses a specific protein, and that may refer to the coding region alone or may include regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "GPAT promoter" or "GPAT promoter region" refers to the 5' upstream untranslated region in front of the 'ATG' translation initiation codon of a glycerol-3-phosphate O-acyltransferase enzyme (E.C. 2.3.1.15) encoded by the gpat gene and that is necessary for expression. Examples of suitable *Yarrowia lipolytica* GPAT promoter regions are described in U.S. patent application Ser. No. 11/225,354.

The term "GPD promoter" or "GPD promoter region" refers to the 5' upstream untranslated region in front of the 'ATG' translation initiation codon of a glyceraldehyde-3-phosphate dehydrogenase enzyme (E.C. 1.2.1.12) encoded by the gpd gene and that is necessary for expression. Examples of suitable *Yarrowia lipolytica* GPD promoter regions are described in WO 2005/003310.

The term "GPM promoter" or "GPM promoter region" refers to the 5' upstream untranslated region in front of the 'ATG' translation initiation codon of a phosphoglycerate mutase enzyme (EC 5.4.2.1) encoded by the gpm gene and that is necessary for expression. Examples of suitable *Yarrowia lipolytica* GPM promoter regions are described in WO 2005/003310.

The term "FBA promoter" or "FBA promoter region" refers to the 5' upstream untranslated region in front of the 'ATG' translation initiation codon of a fructose-bisphosphate aldolase enzyme (E.C. 4.1.2.13) encoded by the fba1 gene and that is necessary for expression. Examples of suitable *Yarrowia lipolytica* FBA promoter regions are described in WO 2005/049805.

The term "FBAIN promoter" or "FBAIN promoter region" refers to the 5' upstream untranslated region in front of the 'ATG' translation initiation codon of the fba1 gene and that is necessary for expression, plus a portion of 5' coding region that has an intron of the fba1 gene. Examples of suitable *Yarrowia lipolytica* FBAIN promoter regions are described in WO 2005/049805.

The term "GPDIN promoter" or "GPDIN promoter region" refers to the 5' upstream untranslated region in front of the 'ATG' translation initiation codon of the gpd gene and that is necessary for expression, plus a portion of 5' coding region that has an intron of the gpd gene. Examples of suitable *Yarrowia lipolytica* GPDIN promoter regions are described in U.S. patent application Ser. No. 11/183,664.

The term "YAT1 promoter" or "YAT1 promoter region" refers to the 5' upstream untranslated region in front of the 'ATG' translation initiation codon of an ammonium transporter enzyme (TC 2.A.49; GenBank Accession No. XM_504457) encoded by the yat1 gene and that is necessary for expression. Examples of suitable *Yarrowia lipolytica* YAT1 promoter regions are described in U.S. patent application Ser. No. 11/185,301.

The term "EXP1 promoter" or "EXP1 promoter region" refers to the 5' upstream untranslated region in front of the 'ATG' translation initiation codon of a protein encoded by the *Yarrowia lipolytica* "YALI0C12034g" gene (GenBank Accession No. XM_501745) and that is necessary for expression. Based on significant homology of "YALI0C12034g" to the sp|Q12207 *S. cerevisiae* non-classical export protein 2 (whose function is involved in a novel pathway of export of proteins that lack a cleavable signal sequence), this gene is herein designated as the exp1 gene, encoding a protein designated as EXP1. An example of a suitable *Yarrowia lipolytica* EXP1 promoter region is described as SEQ ID NO:389, but this is not intended to be limiting in nature. One skilled in the art will recognize that since the exact boundaries of the EXP1 promoter sequence have not been completely defined, DNA fragments of increased or diminished length may have identical promoter activity.

The term "promoter activity" will refer to an assessment of the transcriptional efficiency of a promoter. This may, for instance, be determined directly by measurement of the amount of mRNA transcription from the promoter (e.g., by Northern blotting or primer extension methods) or indirectly by measuring the amount of gene product expressed from the promoter.

"Introns" are sequences of non-coding DNA found in gene sequences (either in the coding region, 5' non-coding region, or 3' non-coding region) in most eukaryotes. Their full function is not known however, some enhancers are located in introns (Giacopelli F. et al., *Gene Expr.* 11: 95-104 (2003)). These intron sequences are transcribed, but removed from within the pre-mRNA transcript before the mRNA is translated into a protein. This process of intron removal occurs by self-splicing of the sequences (exons) on either side of the intron.

The term "enhancer" refers to a cis-regulatory sequence that can elevate levels of transcription from an adjacent eukaryotic promoter, thereby increasing transcription of the gene. Enhancers can act on promoters over many tens of kilobases of DNA and can be 5' or 3' to the promoter they regulate. Enhancers can also be located within introns.

The terms "3' non-coding sequences" and "transcription terminator" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" or "mRNA" refers to the RNA that is without introns and that can be translated into protein by the cell. "cDNA" refers to a double-stranded DNA that is complementary to, and derived from, mRNA. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065; WO 99/28508). The complementarity of an antisense RNA may be with any part of the specific gene transcript, i.e., at the 5' non-coding sequence, 3' non-coding sequence, or the coding sequence. "Functional RNA" refers to antisense RNA, ribozyme RNA, or other RNA that is not translated and yet has an effect on cellular processes.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragments of the invention. Expression may also refer to translation of mRNA into a polypeptide.

"Mature" protein refers to a post-translationally processed polypeptide, i.e., one from which any pre- or propeptides present in the primary translation product have been removed. "Precursor" protein refers to the primary product of translation of mRNA, i.e., with pre- and propeptides still present. Pre- and propeptides may be (but are not limited to) intracellular localization signals.

The term "recombinase" refers to an enzyme(s) that carries out site-specific recombination to alter the DNA structure and includes transposases, lambda integration/excision enzymes, as well as site-specific recombinases.

"Recombinase site" or "site-specific recombinase sequence" means a DNA sequence that a recombinase will recognize and bind to. It will be appreciated that this may be a wild type or mutant recombinase site, as long as functionality is maintained and the recombinase enzyme may still recognize the site, bind to the DNA sequence, and catalyze the recombination between two adjacent recombinase sites.

"Transformation" refers to the transfer of a nucleic acid molecule into a host organism, resulting in genetically stable inheritance. The nucleic acid molecule may be a plasmid that replicates autonomously, for example, or, it may integrate into the genome of the host organism. Host organisms containing the transformed nucleic acid fragments are referred to as "transgenic" or "recombinant" or "transformed" organisms.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Expression cassette" refers to a specific vector containing a foreign gene and having elements in addition to the foreign gene that allow for enhanced expression of that gene in a foreign host.

The term "homologous recombination" refers to the exchange of DNA fragments between two DNA molecules (during cross over). The fragments that are exchanged are flanked by sites of identical nucleotide sequences between the two DNA molecules (i.e., "regions of homology"). The term "regions of homology" refer to stretches of nucleotide sequence on nucleic acid fragments that participate in homologous recombination that have homology to each other. Effective homologous recombination will generally take place where these regions of homology are at least about 10 bp in length where at least about 50 bp in length is preferred. Typically fragments that are intended for recombination contain at least two regions of homology where targeted gene disruption or replacement is desired.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.* 215:403-410 (1990)); 3.) DNAS-TAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family. A motif that is indicative of a fungal protein having Δ15 desaturase activity is provided as SEQ ID NO:405, while a motif that is indicative of a fungal protein having Δ12 desaturase activity is provided as SEQ ID NO:406.

Standard recombinant DNA and molecular cloning techniques used herein are well known in the art and are described by Sambrook, J., Fritsch, E. F. and Maniatis, T., *Molecular Cloning: A Laboratory Manual*, 2nd ed., Cold Spring Harbor Laboratory: Cold Spring Harbor, N.Y. (1989) (hereinafter "Maniatis"); by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience (1987).

A Preferred Microbial Host for EPA Production: *Yarrowia Lipolytica*

Prior to work by the Applicants (see, Picataggio et al., WO2004/101757), oleaginous yeast have not been examined previously as a class of microorganisms suitable for use as a production platform for PUFAs. Genera typically identified as oleaginous yeast include, but are not limited to: *Yarrowia, Candida, Rhodotorula, Rhodosporidium, Cryptococcus, Trichosporon* and *Lipomyces*. More specifically, illustrative oil-synthesizing yeast include: *Rhodosporidium toruloides, Lipomyces starkeyii, L. lipoferus, Candida revkaufi, C. pulcherrima, C. tropicalis, C. utilis, Trichosporon pullans, T. cutaneum, Rhodotorula glutinus, R. graminis* and *Yarrowia lipolytica* (formerly classified as *Candida* lipolytica).

Oleaginous yeast were considered to have several qualities that would faciliate their use as a host organism for economical, commercial production of EPA. First, the organisms are defined as those that are naturally capable of oil synthesis and accumulation, wherein the oil can comprise greater than about 25% of the cellular dry weight, more preferably greater than about 30% of the cellular dry weight and most preferably greater than about 40% of the cellular dry weight. Secondly, the technology for growing oleaginous yeast with high oil content is well developed (for example, see EP 0 005 277B1; Ratledge, C., *Prog. Ind. Microbiol.* 16:119-206 (1982)). These organisms have been commercially used for a variety of purposes in the past. For example, various strains of *Yarrowa lipolytica* have historically been used for the manufacture and production of: isocitrate lyase (DD259637); lipases (SU1454852, WO2001083773, DD279267); polyhydroxyalkanoates (WO2001088144); citric acid (RU2096461, RU2090611, DD285372, DD285370, DD275480, DD227448, PL160027); erythritol (EP770683); 2-oxoglutaric acid (DD267999); γ-decalactone (U.S. Pat. No. 6,451, 565, FR2734843); γ-dodecalactone (EP578388); and pyruvic acid (JP09252790).

Of those organisms classified as oleaginous yeast, *Yarrowia lipolytica* was selected as the preferred microbial host for the purposes herein. This selection was based on the knowledge that oleaginous strains were available that were capable of incorporating ω-3 fatty acids into the TAG fraction, the organism was amenable to genetic manipulation, and previous use of the species as a Generally Recognized As Safe ("GRAS", according to the U.S. Food and Drug Administration) source of food-grade citric acid. In a further embodiment, most preferred are the *Y. lipolytica* strains designated as ATCC #20362, ATCC #8862, ATCC #18944, ATCC #76982 and/or LGAM S(7)1 (Papanikolaou S., and Aggelis G., *Bioresour. Technol.* 82(1):43-9 (2002)), due to preliminary studies targeted toward identification of wildtype strains having high lipid content (measured as a percent dry weight) and high volumetric productivity (measured as g/L h$^{-1}$).

As described in WO 2004/101757, *Yarrowia lipolytica* was previously genetically engineered to produce 1.3% ARA and 1.9% EPA, respectively, by introduction and expression of genes encoding the ω-3/ω-6 biosynthetic pathway. More specifically, two different DNA expression constructs (comprising either a Δ6 desaturase, Δ5 desaturase and high-affinity PUFA $C_{18/20}$ elongase for ARA synthesis or a Δ6 desaturase, Δ5 desaturase, high-affinity PUFA $C_{18/20}$ elongase and codon-optimized Δ17 desaturase for EPA synthesis) were separately transformed and integrated into the *Y. lipolytica* chromosomal URA3 gene encoding the enzyme orotidine-5'-phosphate decarboxylase (EC 4.1.1.23). GC analysis of the host cells fed with appropriate substrates detected production of ARA and EPA. Although suitable to demonstrate proof-of-concept for the ability of oleaginous hosts to be genetically engineered for production of ω-6 and ω-3 fatty acids, this work failed to perform the complex metabolic engineering required to enable synthesis of greater than 5% EPA in the total oil fraction, or more preferably greater than 10% EPA in the total oil fraction, or even more preferably greater than 15-20% EPA in the total oil fraction, or most preferably greater than 25-30% EPA in the total oil fraction.

In the present Application, complex metabolic engineering is performed to: (1) identify preferred desaturases and elongases that allow for the synthesis and high accumulation of EPA; (2) manipulate the activity of acyltransferases that allow for the transfer of omega fatty acids into storage lipid pools (i.e., the triacylglyercol fraction); (3) over-express desaturases, elongases and acyltransferases by use of strong promoters, expression in multicopy, and/or codon-optimization; (4) down-regulate the expression of specific genes within the PUFA biosynthetic pathway that diminish overall accumulation of EPA; and, (5) manipulate pathways and global regulators that affect EPA production. Each of these aspects of metabolic engineering will be discussed below, as will fermentation methods to further enhance EPA productivity in this oleaginous yeast.

An Overview: Microbial Biosynthesis of Fatty Acids and Triacylglycerols

In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in WO 2004/101757. Palmitate is the precursor of longer-chain saturated and unsaturated fatty acid derivates, which are formed through the action of elongases and desaturases. For example, palmitate is converted to its unsaturated derivative [palmitoleic acid (16:1)] by the action of a Δ9 desaturase. Similarly, palmitate is elongated by a $C_{16/18}$ fatty acid elongase to form stearic acid (18:0), which can be converted to its unsaturated derivative by a Δ9 desaturase to thereby yield oleic (18:1) acid.

Figure 2:
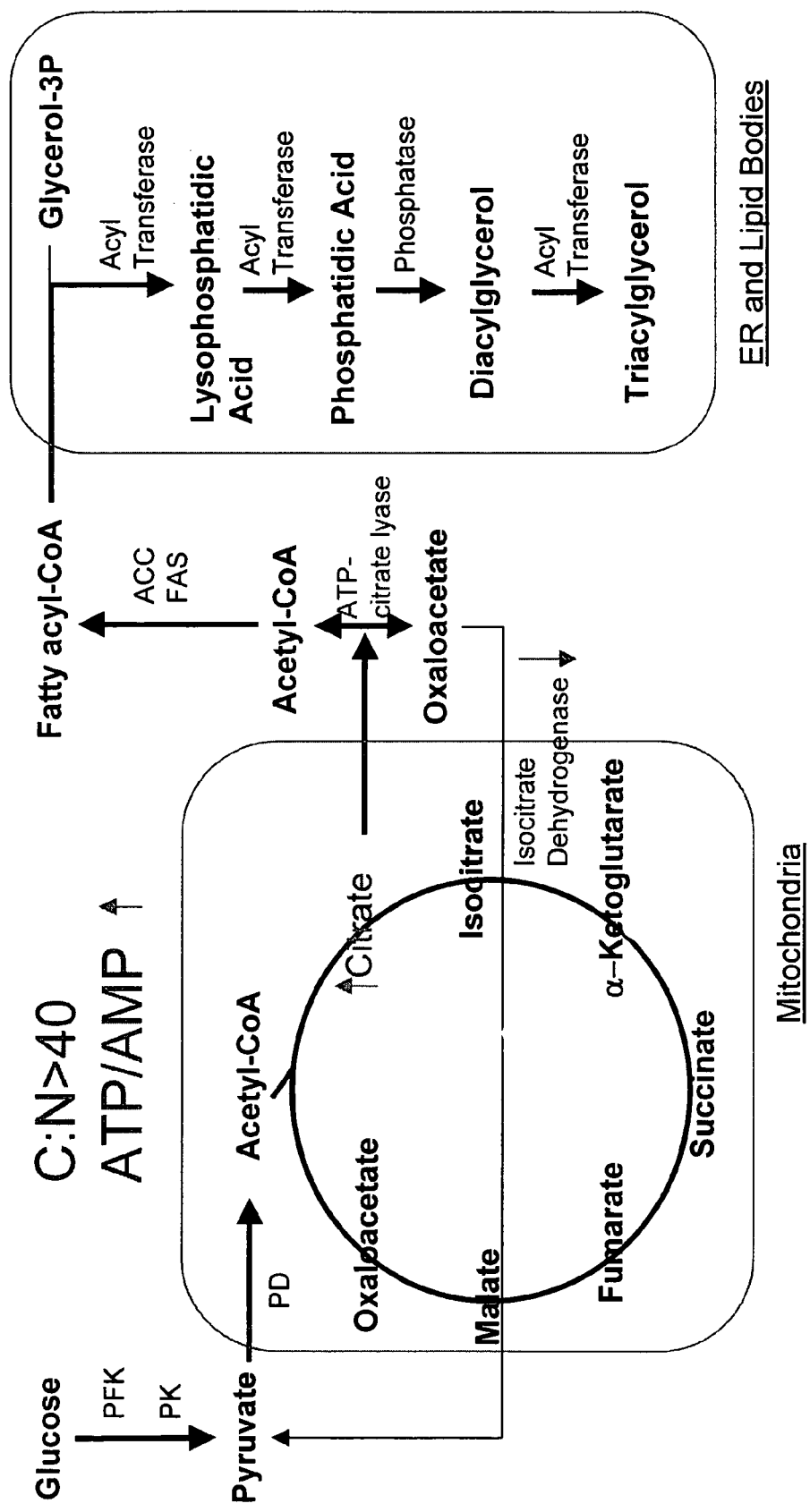
FIG. 2 is a schematic illustration of the biochemical mechanism for lipid accumulation in oleaginous yeast.

TAGs (the primary storage unit for fatty acids) are formed by a series of reactions that involve: 1.) the esterification of one molecule of acyl-CoA to glycerol-3-phosphate via an acyltransferase to produce lysophosphatidic acid; 2.) the esterification of a second molecule of acyl-CoA via an acyltransferase to yield 1,2-diacylglycerol phosphate (commonly identified as phosphatidic acid); 3.) removal of a phosphate by phosphatidic acid phosphatase to yield 1,2-diacylglycerol (DAG); and 4.) the addition of a third fatty acid by the action of an acyltransferase to form TAG (FIG. 2).

A wide spectrum of fatty acids can be incorporated into TAGs, including saturated and unsaturated fatty acids and short-chain and long-chain fatty acids. Some non-limiting examples of fatty acids that can be incorporated into TAGs by acyltransferases include: capric (10:0), lauric (12:0), myristic (14:0), palmitic (16:0), palmitoleic (16:1), stearic (18:0), oleic (18:1), vaccenic (18:1), LA, eleostearic (18:3), ALA, GLA, arachidic (20:0), EDA, ETrA, DGLA, ETA, ARA, EPA, behenic (22:0), DPA, DHA, lignoceric (24:0), nervonic (24:1), cerotic (26:0), and montanic (28:0) fatty acids. In preferred embodiments of the present invention, incorporation of EPA into TAG is most desirable.

Biosynthesis of EPA, an ω-3 Fatty Acid

The metabolic process wherein oleic acid is converted to EPA involves elongation of the carbon chain through the addition of carbon atoms and desaturation of the molecule through the addition of double bonds. This requires a series of special desaturation and elongation enzymes present in the endoplasmic reticulim membrane. However, as seen in FIG. 1 and as described below, multiple alternate pathways exist for EPA production.

Specifically, all pathways require the initial conversion of oleic acid to LA (18:2), the first of the ω-6 fatty acids, by the action of a Δ12 desaturase. Then, using the "ω-6 Δ6 desaturase/Δ6 elongase pathway" for EPA biosynthesis (whereby EPA biosynthesis occurs primarily through the formation of ω-6 fatty acids), PUFAs are formed as follows: (1) LA is converted to GLA by the action of a Δ6 desaturase; (2) GLA is converted to DGLA by the action of a $C_{18/20}$ elongase; (3) DGLA is converted to ARA by the action of a Δ5 desaturase; and (4) ARA is converted to EPA by the action of a Δ17 desaturase. Alternatively, when EPA biosynthesis occurs primarily through the formation of (ω-3 fatty acids via the "ω-3 Δ6 desaturase/Δ6 elongase pathway", (1) LA is converted to ALA, the first of the ω-3 fatty acids, by the action of a Δ15 desaturase; (2) ALA is converted to STA by the action of a Δ6 desaturase; (3) STA is converted to ETA by the action of a $C_{18/20}$ elongase; and (4) ETA is converted to EPA by the action of a Δ5 desaturase. Optionally, a combination of ω-6 and ω-3 fatty acids can be synthesized prior to production of EPA, either when ETA is produced from DGLA by the action of a Δ17 desaturase, or when both Δ15 desaturase and Δ17 desaturase are co-expressed in conjunction with a Δ6 desaturase, $C_{18/20}$ elongase and Δ5 desaturase.

Alternate pathways for the biosynthesis of EPA utilize a Δ9 elongase and Δ8 desaturase. More specifically, via the "ω-6 Δ9 elongase/Δ8 desaturase pathway", LA is converted to EDA by the action of a Δ9 elongase, then, a Δ8 desaturase converts EDA to DGLA. Subsequent desaturation of DGLA by the action of a Δ5 desaturase yields ARA, as described above, wherein ARA can be converted directly to EPA by the action of a Δ17 desaturase. In contrast, using the "ω-3 Δ9 elongase/Δ8 desaturase pathway", LA is first converted to ALA by the action of a Δ15 desaturase Then, ALA is converted to ETrA by the action of a Δ9 elongase, followed by a Δ8 desaturase that converts ETrA to ETA. Subsequent desaturation of ETA by the action of a Δ5 desaturase yields EPA.

For the sake of clarity, each of these pathways will be summarized in the Table below, as well as their distinguishing characteristics:

TABLE 4

Alternate Biosynthetic Pathways For EPA Biosynthesis

| Name | Minimum Required Genes For EPA* | Pathway |
|---|---|---|
| ω-6 Δ6 desaturase/Δ6 elongase pathway | Δ6D, $C_{18/20}$ ELO, Δ5D, Δ17D | improves the ω-3/ω-6 ratio of PUFA products |
| ω-3 Δ6 desaturase/Δ6 elongase pathway | Δ15D, Δ6D, $C_{18/20}$ ELO, Δ5D | improves the ω-3/ω-6 ratio of substrates for subsequent PUFA biosynthesis; produces oil that is devoid of GLA |
| Combination Δ6 desaturase/Δ6 elongase pathway | Δ15D, Δ6D, $C_{18/20}$ ELO, Δ5D, Δ17D | — |
| ω-6 Δ9 elongase/Δ8 desaturase pathway | Δ9 ELO, Δ8D, Δ5D, Δ17D | improves the ω-3/ω-6 ratio of PUFA products |
| ω-3 Δ9 elongase/Δ8 desaturase pathway | Δ15D, Δ9 ELO, Δ8D, Δ5D | improves the ω-3/ω-6 ratio of substrates for subsequent PUFA biosynthesis; produces oil that is devoid of GLA |
| Combination Δ9 elongase/Δ8 desaturase pathway | Δ15D, Δ9 ELO, Δ8D, Δ5D, Δ17D | — |

*Abbreviations: "D" = desaturase; "ELO" = elongase.

If desirable, several other PUFAs can be produced using EPA as substrate. For example, EPA can be further converted to DHA by the action of a $C_{20/22}$ elongase and a Δ4 desaturase.

Selection of Microbial Genes for EPA Synthesis

It is contemplated that the particular functionalities required to be introduced into *Yarrowia lipolytica* for production of EPA will depend on the host cell (and its native PUFA profile and/or desaturase/elongase profile), the availability of substrate, and the desired end product(s). With respect to the native host cell, it is known that *Y. lipolytica* can naturally produce 18:2 fatty acids and thus possesses a native Δ12 desaturase (SEQ ID NOs:23 and 24; see WO 2004/104167). With respect to the desired end products, the consequences of Δ6 desaturase/Δ6 elongase pathway expression as opposed to Δ9 elongase/Δ8 desaturase pathway expression have been described above, in terms of the final fatty acid profile of oil so produced (i.e., % GLA in the final composition of high EPA oil).

In some embodiments, it will therefore be desirable to produce EPA via the Δ6 desaturase/Δ6 elongase pathway. Thus, at a minimum, the following genes must be introduced into the host organism and expressed for EPA biosynthesis: a Δ6 desaturase, a $C_{18/20}$ elongase, a Δ5 desaturase and either a Δ17 desaturase or a Δ15 desaturase (or both). In a further preferred embodiment, the host strain additionally includes at least one of the following: a Δ9 desaturase, a Δ12 desaturase, a $C_{14/16}$ elongase and a $C_{16/18}$ elongase.

In alternate embodiments, it is desirable to produce EPA without co-synthesis of GLA (thus requiring expression of the Δ9 elongase/Δ8 desaturase pathway). This strategy thereby minimally requires the following genes to be introduced into the host organism and expressed for EPA biosynthesis: a Δ9 elongase, a Δ8 desaturase, a Δ5 desaturase and either a Δ17 desaturase or a Δ15 desaturase (or both). In a further preferred embodiment, the host strain additionally includes at least one of the following: a Δ9 desaturase, a Δ12 desaturase, a $C_{14/16}$ elongase and a $C_{16/18}$ elongase.

One skilled in the art will be able to identify various candidate genes encoding each of the enzymes desired for EPA biosynthesis. Useful desaturase and elongase sequences may be derived from any source, e.g., isolated from a natural source (from bacteria, algae, fungi, plants, animals, etc.), produced via a semi-synthetic route or synthesized de novo. Although the particular source of the desaturase and elongase genes introduced into the host is not critical to the invention, considerations for choosing a specific polypeptide having desaturase or elongase activity include: 1.) the substrate specificity of the polypeptide; 2.) whether the polypeptide or a component thereof is a rate-limiting enzyme; 3.) whether the desaturase or elongase is essential for synthesis of a desired PUFA; and/or 4.) co-factors required by the polypeptide. The expressed polypeptide preferably has parameters compatible with the biochemical environment of its location in the host cell. For example, the polypeptide may have to compete for substrate with other enzymes in the host cell. Analyses of the $K_M$ and specific activity of the polypeptide therefore may be considered in determining the suitability of a given polypeptide for modifying PUFA production in a given host cell. The polypeptide used in a particular host cell is one that can function under the biochemical conditions present in the intended host cell but otherwise can be any polypeptide having desaturase or elongase activity capable of modifying the desired PUFA.

In additional embodiments, it will also be useful to consider the conversion efficiency of each particular desaturase and/or elongase. More specifically, since each enzyme rarely functions with 100% efficiency to convert substrate to product, the final lipid profile of un-purified oils produced in a host cell will typically be a mixture of various PUFAs consisting of the desired EPA, as well as various upstream intermediary PUFAs (e.g., as opposed to 100% EPA oil). Thus, consideration of each enzyme's conversion efficiency is also an important variable when optimizing biosynthesis of EPA, that must be considered in light of the final desired lipid profile of the product.

With each of the considerations above in mind, candidate genes having the appropriate desaturase and elongase activities can be identified according to publicly available literature (e.g., GenBank), the patent literature, and experimental analysis of microorganisms having the ability to produce PUFAs. For instance, the following GenBank Accession Numbers refer to examples of publicly available genes useful in EPA biosynthesis: AY131238, Y055118, AY055117, AF296076, AF007561, L11421, NM_031344, AF465283, AF465281, AF110510, AF465282, AF419296, AB052086, AJ250735, AF126799, AF126798 (Δ6 desaturases); AF199596, AF226273, AF320509, AB072976, AF489588, AJ510244, AF419297, AF07879, AF067654, AB022097 (Δ5 desaturases); AAG36933, AF110509, AB020033, AAL13300, AF417244, AF161219, AY332747, AAG36933, AF110509, AB020033, AAL13300, AF417244, AF161219, X86736, AF240777, AB007640, AB075526, AP002063 (Δ12 desaturases); NP_441622, BAA18302, BAA02924, AAL36934 (Δ15 desaturases); AF338466, AF438199, E11368, E11367, D83185, U90417, AF085500, AY504633, NM_069854, AF230693 (Δ9 desaturases); AF390174 (Δ9 elongase); AF139720 (Δ8 desaturase); and NP_012339, NP_009963, NP_013476, NP_599209, BAB69888, AF244356, AAF70417, AAF71789, AF390174, AF428243, NP_955826, AF206662, AF268031, AY591335, AY591336, AY591337, AY591338, AY605098, AY605100, AY630573 ($C_{14/16}$, $C_{16/18}$ and $C_{18/20}$ elongases). Similarly, the patent literature provides many additional DNA sequences of genes (and/or details concerning several of the genes above and their methods of isolation) involved in PUFA production [e.g., WO 02/077213 (Δ9 elongases); WO 00/34439 and WO 04/057001 (Δ8 desaturases); U.S. Pat. No. 5,968,809 (Δ6 desaturases); U.S. Pat. No. 5,972,664 and U.S. Pat. No. 6,075,183 (Δ5 desaturases); WO 94/11516, U.S. Pat. No. 5,443,974, WO 03/099216 and WO 05/047485 (Δ12 desaturases); WO 93/11245 (Δ15 desaturases); WO 91/13972 and U.S. Pat. No. 5,057,419 (Δ9 desaturases); U.S. 2003/0196217A1 (Δ17 desaturases); and, WO 00/12720, U.S. Pat. No. 6,403,349, U.S. Pat. No. 6,677,145, U.S. 2002/0139974A1, U.S. 2004/0111763 ($C_{14/16}$, $C_{16/18}$ and $C_{18/20}$ elongases)]. Each of these patents and applications are herein incorporated by reference in their entirety.

The examples above are not intended to be limiting and numerous other genes encoding (1) Δ6 desaturases, $C_{18/20}$ elongases, Δ5 desaturases and either Δ17 desaturases or Δ15 desaturases (or both) (and optionally other genes encoding Δ9 desaturases, Δ12 desaturases, $C_{14/16}$ elongases and/or $C_{16/18}$ elongases); or (2) Δ9 elongases, Δ8 desaturases, Δ5 desaturases and either Δ17 desaturases or Δ15 desaturases (or both) (and optionally other genes encoding Δ9 desaturases, Δ12 desaturases, $C_{14/16}$ elongases and/or $C_{16/18}$ elongases) derived from different sources would be suitable for introduction into Yarrowia lipolytica.

Preferred Genes for EPA Synthesis

Despite the wide selection of desaturases and elongases that could be suitable for expression in Yarrowia lipolytica, however, in preferred embodiments of the present invention the desaturases and elongases are selected from the following (or derivatives thereof):

TABLE 5

Preferred Desaturases And Elongases For EPA Biosynthesis In Yarrowia lipolytica

| ORF | Organism | Reference | SEQ ID NOs |
|---|---|---|---|
| Δ6 desaturase | Mortierella alpina | GenBank Accession No. AF465281; U.S. Pat. No. 5,968,809 | 1, 2 |
| Δ6 desaturase | Mortierella alpina | GenBank Accession No. AB070555 | 4, 5 |
| $C_{18/20}$ elongase ("ELO1") | Mortierella alpina | GenBank Accession No. AX464731; WO 00/12720 | 17, 18 |
| $C_{18/20}$ | Thrausto- | U.S. Pat. No. 6,677,145 | 20, |

TABLE 5-continued

Preferred Desaturases And Elongases For EPA Biosynthesis In *Yarrowia lipolytica*

| ORF | Organism | Reference | SEQ ID NOs |
|---|---|---|---|
| elongase ("ELO2") | *chytrium aureum* | | 21 |
| Δ9 elongase | *Isochrysis galbana* | GenBank Accession No. AF390174 | 49, 50 |
| Δ8 desaturase | *Euglena gracillis* | Co-pending U.S. Patent Application Number 11/166993 | 57, 58 |
| Δ5 desaturase | *Mortierella alpina* | GenBank Accession No. AF067654; U.S. Pat. No. 6,075,183 | 6, 7 |
| Δ5 desaturase | *Isochrysis galbana* | WO 02/081668 A2 | 8, 9 |
| Δ5 desaturase | *Homo sapiens* | GenBank Accession No. NP_037534 | 11, 12 |
| Δ5/Δ6 desaturase | *Danio rerio* | GenBank Accession No. AF309556 | 369, 370 |
| Δ5/Δ6 desaturase | *Danio rerio* | GenBank Accession No. BC068224 | 371 |
| Δ5/Δ6 desaturase | *Danio rerio* | — | 372, 373 |
| Δ17 desaturase | *Saprolegnia diclina* | US 2003/0196217 A1 | 14, 15 |
| C$_{16/18}$ elongase ("YE2") | *Yarrowia lipolytica* | — | 74, 75 |
| C$_{16/18}$ elongase ("ELO3") | *Mortierella alpina* | — | 66, 67 |
| C$_{16/18}$ elongase (rELO2) | *Rattus norvegicus* | GenBank Accession No. AB071986 | 63, 64 |
| C$_{14/16}$ elongase ("YE1") | *Yarrowia lipolytica* | — | 77, 78 |
| Δ12 desaturase | *Yarrowia lipolytica* | WO 2004/104167 | 23, 24 |
| Δ12 desaturase | *Mortieralla isabellina* | GenBank Accession No. AF417245 | 25, 26 |
| Δ12 desaturase (Fm d12) | *Fusarium moniliforme* | WO 2005/047485 | 27, 28 |
| Δ12 desaturase (An d12) | *Aspergillus nidulans* | Contig 1.15 (scaffold 1) in the *A. nidulans* genome project; AAG36933; WO 2005/047485 | 29, 30 |
| Δ12 desaturase | *Aspergillus flavus* | GenBank Accession No. AY280867 (VERSION AY280867.1; gi: 30721844); WO 2005/047485 | 31 |
| Δ12 desaturase (Afd12p) | *Aspergillus fumigatus* | AFA.133c 344248:345586 reverse (AfA5C5.001c) in the *Aspergillus fumigatus* genome project; WO 2005/047485 | 32 |
| Δ12 desaturase (Mg d12) | *Magnaporthe grisea* | Locus MG01985.1 in contig 2.375 in the *M. grisea* genome project; WO 2005/047485 | 33, 34 |
| Δ12 desaturase (Nc d12) | *Neurospora crassa* | GenBank Accession No. AABX01000374; WO 2005/047485 | 35, 36 |
| Δ12 desaturase (Fg d12) | *Fusarium graminearum* | Contig 1.233 in the *F. graminearium* genome project; WO 2005/047485 | 37, 38 |
| Δ12 desaturase (Mad12) | *Mortierella alpina* | GenBank Accession No. AB020033 | 374, 375 |
| Δ12 desaturase (Skd12) | *Saccharomyces kluyveri* | GenBank Accession No. BAD08375 | 376 |
| Δ12 desaturase (Kld12p) | *Kluyveromyces lactis* | gnl\|GLV\|KLLA0B00473g ORF from Klla0B: 35614..36861 antisense (m) of *K. lactis* database of the "Yeast project Genolevures" (Center for Bioinformatics, LaBRI, Talence Cedex, France) | 377, 378 |

TABLE 5-continued

Preferred Desaturases And Elongases For EPA Biosynthesis In *Yarrowia lipolytica*

| ORF | Organism | Reference | SEQ ID NOs |
|---|---|---|---|
| Δ12 desaturase (Cad12p) | *Candida albicans* | GenBank Accession No. EAK94955 | 379 |
| Δ12 desaturase (Dhd12p) | *Debaryomyces hansenii* CBS767 | GenBank Accession No. CAG90237 | 380 |
| Δ15 desaturase (Fm d15) | *Fusarium moniliforme* | WO 2005/047479 | 39, 40 |
| Δ15 desaturase (An d15) | *Aspergillus nidulans* | Contig 1.122 (scaffold 9) in the *A. nidulans* genome project; WO 2005/047479 | 41, 42 |
| Δ15 desaturase (Mg d15) | *Magnaporthe grisea* | Locus MG08474.1 in contig 2.1597 in the *M. grisea* genome project; WO 2005/047479 | 43, 44 |
| Δ15 desaturase (Nc d15) | *Neurospora crassa* | GenBank Accession No. AABX01000577; WO 2005/047479 | 45, 46 |
| Δ15 desaturase (Fg d15) | *Fusarium graminearum* | Contig 1.320 in the *F. graminearium* genome project (BAA33772.1); WO 2005/047479 | 47, 48 |
| Δ15 desaturase (Mad15) | *Mortierella alpina* | GenBank Accession No. AB182163 | 381, 382 |
| Δ15 desaturase (Kld15p) | *Kluyveromyces lactis* | GenBank Accession No. XM_451551 | 383, 384 |
| Δ15 desaturase (Cad15p) | *Candida albicans* | GenBank Accession No. EAL03493 | 385 |
| Δ15 desaturase (Skd15) | *Saccharomyces kluyveri* | GenBank Accession No. BAD11952 | 386 |
| Δ15 desaturase (Dhd15p) | *Debaryomyces hansenii* CBS767 | GenBank Accession No. CAG88182 | 387 |
| Δ15 desaturase (Afd15p) | *Aspergillus fumigatus* | GenBank Accession No. EAL85733 | 388 |

*Note: The *Aspergillus fumigatus* genome project is sponsored by Sanger Institute, collaborators at the University of Manchester and The Institute of Genome Research (TIGR); the *A. nidulans* genome project is sponsored by the Center for Genome Research (CGR), Cambridge, MA; the *M. grisea* genome project is sponsored by the CGR and International Rice Blast Genome Consortium; the *F. graminearium* genome project is sponsored by the CGR and the International *Gibberella zeae* Genomics Consortium (IGGR).

The Applicants have performed considerable analysis of various elongases, to either determine or confirm each enzyme's substrate specificity and/or substrate selectivity when expressed in *Yarrowia lipolytica*. For example, although the coding sequences of the two *Y. lipolytica* elongases were publically available and each protein was annotated as a putative long-chain fatty-acyl elongase or shared significant homology to other fatty acid elongases, the substrate specificity of these enzymes had never been determined. Based on the analyses performed herein, YE1 was positively determined to be a fatty acid elongase that preferentially used $C_{14}$ fatty acids as substrates to produce $C_{16}$ fatty acids (i.e., a $C_{14/16}$ elongase) and YE2 was determined to be a fatty acid elongase that preferentially used $C_{16}$ fatty acids as substrates to produce $C_{18}$ fatty acids (i.e., a $C_{16/18}$ elongase). Relatedly, upon identification of the novel *M. alpina* ELO3 gene, the sequence was characterized as homologous to other fatty acid elongases. However, lipid profile analyses were required to confirm the specificity of ELO3 as a $C_{16/18}$ elongase.

With respect to Δ12 desaturase, the Applicants have made the surprising discovery that the *Fusarium moniliforme* Δ12 desaturase (encoded by SEQ ID NO:27) functions with greater efficiency than the native *Yarrowia lipolytica* Δ12 desaturase in producing 18:2 in *Y. lipolytica* (see WO 2005/047485). Specifically, expression of the *F. moniliforme* Δ12 desaturase under the control of the TEF promoter in *Y. lipolytica* was determined to produce higher levels of 18:2 (68% product accumulation of LA) than were previously attainable by expression of a chimeric gene encoding the *Y. lipolytica* Δ12 desaturase under the control of the TEF promoter (59% product accumulation of LA). This corresponds to a difference in percent substrate conversion (calculated as ([18:2+18:3]/[18:1+18:2+18:3])*100) of 85% versus 74%, respectively. On the basis of these results, expression of the present fungal *F. moniliforme* Δ12 desaturase is preferred relative to other known Δ12 desaturases as a means to engineer a high EPA-producing strain of *Y. lipolytica* (however, one skilled in the art would expect that the activity of the *F. moniliforme* Δ12 desaturase could be enhanced in *Y. lipolytica*, following e.g., codon-optimization).

Alternatively, five new Δ12 desaturases have recently been identified that could possibly function with improved efficiency in *Yarrowia lipolytica*. Specifically, the *Saccharomyces kluyveri* Δ12 desaturase (GenBank Accession No. BAD08375) was described in Watanabe et al. (*Biosci. Biotech. Biochem*. 68(3):721-727 (2004)), while that from *Mortierella alpina* (GenBank Accession No. AB182163) was described by Sakuradani et al. (*Eur. J. Biochem*. 261(3):812-820 (1999)). Using these sequences, and the methodology described infra, three additional Δ12 desaturases were identified by the Applicants herein: *Kluyveromyces lactis* gnl|GLV|KLLA0B00473g ORF (SEQ ID NO:378), *Candida albicans* GenBank Accession No. EAK94955 (SEQ ID NO:379) and *Debaryomyces hansenii* CBS767 GenBank Accession No. CAG90237 (SEQ ID NO:380). Overexpression of any of these additional Δ12 desaturases in *Yarrowia lipolytica* could be useful as a means to increase production of LA, thereby enabling increased production of other downstream PUFAs (e.g., EPA).

In another preferred embodiment, *F. moniliforme* (SEQ ID NOs:39 and 40) is the preferred Δ15 desaturase for increasing the production of ALA, since this particular Δ15 desaturase possesses several unique characteristics as compared to previously known Δ15 desaturases. First, the *F. moniliforme* Δ15 desaturase is distinguished by its significant Δ12 desaturase activity (thus characterizing the enzyme as bifunctional). Previous studies have determined that a Δ12 desaturase-disrupted strain of *Yarrowia lipolytica* that was transformed with a chimeric gene encoding SEQ ID NO:40 was able to convert 24% of oleic acid to LA (percent substrate conversion calculated as ([18:2+18:3]/[18:1+18:2+18:3])*100), in addition to 96% of LA to ALA (percent substrate conversion calculated as [18:3]/[18:2+18:3]*100)). Secondly, the *F. moniliforme* Δ15 desaturase enables very high synthesis of ALA when expressed in *Y. lipolytica* [i.e., *Y. lipolytica* that was transformed with a chimeric gene encoding SEQ ID NO:40 was able to demonstrate a % product accumulation of ALA of 31%, relative to the total fatty acids in the transformant host cell, which is equivalent to a conversion efficiency to ALA of 83% (calculated as [18:3]/[18:2+18:3]*100)], relative to that described for other heterologously expressed Δ15 desaturases (e.g., the % product accumulation of ALA when expressing the *C. elegans* Δ15 desaturase in the non-oleaginous yeast *Sacchromyces cerevisiae* was only 4.1% (Meesapyodsuk et al., *Biochem.* 39:11948-11954 (2000)), while the % product accumulation of ALA when expressing the *B. napus* Δ15 desaturase in *S. cerevisiae* was only 1.3% (Reed., D. W. et al., *Plant Physiol.* 122:715-720 (2000)). Finally, the *F. moniliforme* Δ15 enzyme has relatively broad substrate specificity on downstream ω-6 derivatives of 18:2. Specifically, the Δ15 desaturase is able to catalyze conversion of GLA to STA, DGLA to ETA, and ARA to EPA.

Figure 3A:
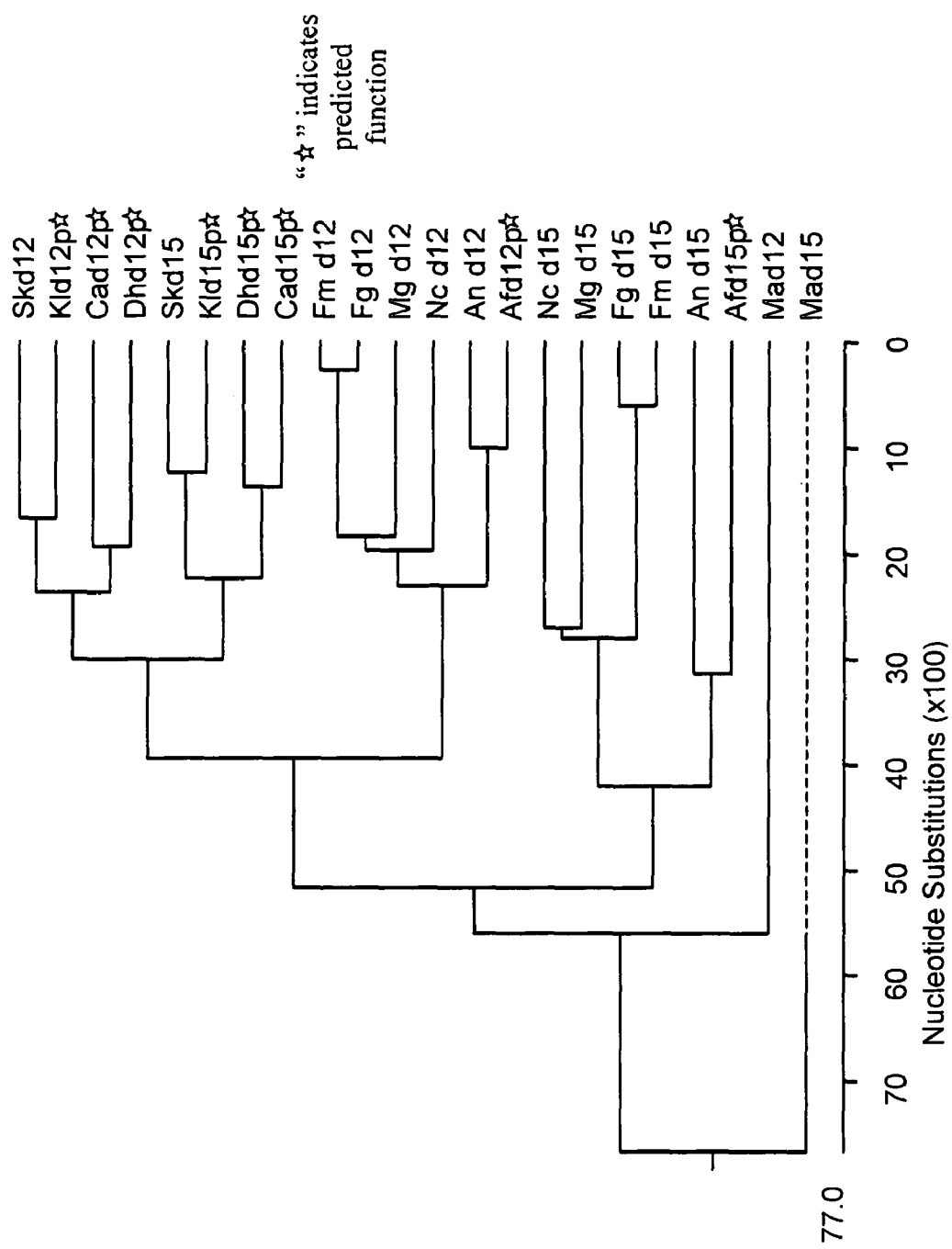
FIG. 3A shows a phylogenetic tree of Δ12 desaturase and Δ15 desaturase proteins from different filamentous fungi and created using Megalign DNASTAR software.

Despite the current identification of the *F. moniliforme* Δ15 enzyme as the preferred Δ15 desaturase, six new Δ15 desaturases have recently been identified that could possibly function with improved efficiency in *Yarrowia lipolytica*. Specifically, the *Saccharomyces kluyveri* Δ15 desaturase (GenBank Accession No. BAD11952; Skd15) was described in Oura et al. (*Microbiol.* 150:1983-1990 (2004)), while that from *Mortierella alpina* (GenBank Accession No. AB182163; Mad15) was described by Sakuradani et al. (*Appl. Microbiol. Biotechnol.* 66:648-654 (2005)). Since both sequences were identified in part based on their close homology to previously identified *S. kluyveri* and *M. alpina* Δ12 desaturases, respectively, followed by a determination of their functional activity, these two pairs of proteins provided additional examples of closely related fungal Δ12 and Δ15 desaturases similar to those of *Fusarium moniliforme, Aspergillus nidulans, Magnaporthe grisea, Neurospora crassa* and *Fusarium graminearium* (see Table above). This finding offered additional support to the Applicants' previous hypothesis that "pairs" of fungal Δ12 desaturase-like sequences likely comprise one protein having Δ15 desaturase activity and one protein having Δ12 desaturase activity (see WO 2005/047480 and WO 2005/047485). Similar "pairs" of Δ12 desaturase-like proteins were thus identified herein in *Kluyveromyces lactis, Candida albicans, Debaryomyces hansenii* CBS767 and *Aspergillus fumigatus*; and, as predicted, one member of each pair aligned more closely to the previously identified *S. kluyveri* Δ12 desaturase (Skd12) and the other more closely to Skd 15 (FIG. 3A). Thus, based on this analysis, the Applicants have identified *K. lactis* GenBank Accession No. XM_451551, *D. hansenii* CBS767 GenBank Accession No. CAG88182, *C. albicans* GenBank Accession No. EAL03493 and *A. fumigatus* GenBank Accession No. EAL85733 as putative fungal Δ15 desaturases whose overexpression in *Y. lipolytica* could be useful to increase production of ω-3 fatty acids.

In additional embodiments, the Applicants have identified a means to readily distinguish fungal sequences having Δ15 desaturase activity as opposed to Δ12 desaturase activity. Specifically, when an amino acid sequence alignment was analysed that comprised Mad12, Skd12, Nc d12, Fm d12, Mg d12, An d12, Fg d12, Dhd12p, Kld12p, Cad12p, Afd12p, Mad15, Skd15, Nc d15, Fm d15, Mg d15, An d15, Fg d15, Dhd15p, Kld15p, Cad15p and Afd15p (see Table above), it became apparent that all of the fungal Δ15 or Δ12 desaturases contained either an Ile or Val amino acid residue, respectively, at the position that corresponds to position 102 of Fm d15 (SEQ ID NO:40) and that is only three amino acid residues away from the highly conserved His Box 1 ("HECGH"; SEQ ID NO:404) (Table 6).

TABLE 6

Amino Acid Alignment Around The Conserved His Box 1 Of Fungal Δ12 And Δ15 Desaturases

| Corresponding Amino Acid Residues | Motif | Desaturase |
|---|---|---|
| 107-118 of SEQ ID NO: 375 | W V L A H E C G H Q S F | Mad12 |
| 116-127 of SEQ ID NO: 376 | W V L A H E C G H Q A F | Skd12 |
| 153-164 of SEQ ID NO: 36 | W V L A H E C G H G A F | Nc d12 |
| 149-160 of SEQ ID NO: 28 | W V I A H E C G H G A F | Fm d12 |
| 160-171 of SEQ ID NO: 34 | W V L A H E C G H Q A F | Mg d12 |
| 143-154 of SEQ ID NO: 30 | W V L A H E C G H Q A F | An d12 |
| 130-141 of SEQ ID NO: 38 | W V I A H E C G H G A F | Fg d12 |
| 106-117 of SEQ ID NO: 378 | W V L A H E C G H Q A F | Kld12p |
| 135-146 of SEQ ID NO: 379 | W V L A H E C G H Q A F | Mad12 |
| 120-131 of SEQ ID NO: 380 | W V L A H E C G H Q A F | Mad12 |
| 142-153 of SEQ ID NO: 32 | W V L A H E C G H Q A F | Afd12p |
| 105-116 of SEQ ID NO: 382 | W I L A H E C G H G A F | Mad15 |
| 117-128 of SEQ ID NO: 386 | W I L A H E C G H S A F | Skd15 |
| 119-130 of SEQ ID NO: 46 | W I L A H E C G H G A F | Nc d15 |
| 101-112 of SEQ ID NO: 40 | W I L G H E C G H G A F | Fm d15 |
| 95-106 of SEQ ID NO: 44 | W I L A H E C G H G A F | Mg d15 |
| 88-99 of SEQ ID NO: 42 | W I L A H E C G H G A F | An d15 |
| 101-112 of SEQ ID NO: 48 | W I L G H E C G H G A F | Fg d15 |
| 117-128 of SEQ ID NO: 384 | W I L A H E C G H G A F | Kld15p |
| 130-141 of SEQ ID NO: 385 | W I L A H E C G H G A F | Cad15 |
| 132-143 of SEQ ID NO: 387 | W I L A H E C G H G A F | Dhd15p |
| 94-105 of SEQ ID NO: 388 | W I L A H E C G H G A F | Afd15p |

The Applicants conclude that Ile and Val at this position is a determinant of Δ15 and Δ12 desaturase specificity, respectively, in fungal desaturases. More specifically, the Applicants propose that any fungal Δ12 desaturase-like protein with Ile at the corresponding residue(s) (i.e., or the motif IXXHECGH [SEQ ID NO:405]) will be a Δ15 desaturase and any fungal Δ12 desaturase-like protein with Val at the corresponding residue(s) (i.e., or the motif VXXHECGH [SEQ ID NO:406]) will be a Δ12 desaturase. Thus, this single leucine/valine amino acid will be an important residue to consider as future fungal desaturases are identified and annotated. Futhermore, it is contemplated that mutation(s) that result in a Ile-to-Val change at this position will alter enzyme specificity, such as towards Δ12 desaturation, in genes encoding fungal Δ12 desaturase-like proteins (e.g., the *Fusarium monoliforme* desaturase described herein as SEQ ID NO:40); and, conversely, those mutations that result in a Val-to-Ile change at this position will alter enzyme specificity, such as towards Δ15 desaturation.

In preferred embodiments various Δ5 desaturases may be selected as most advantageous to express in a host cell for EPA production, depending on the particular pathway that is to be utilized. Specifically, when expressing the ω-6 Δ6 desaturase/Δ6 elongase pathway or the ω-6 Δ9 elongase/Δ8 desaturase pathway, the *M. alpina, I. galbana* and *H. sapiens* Δ5 desaturases are preferred. In contrast, when it is desirable to utilize the ω-3 Δ6 desaturase/Δ6 elongase pathway or the ω-3 Δ9 elongase/Δ8 desaturase pathway (thereby favoring synthesis of α-3 PUFAs), it may be advantageous to utilize an ω-3-preferring Δ5 desaturase, such as that from *Phytopthera megasperma* or from *Danio rerio*. Hastings et al. originally reported that expression of a *Danio rerio* cDNA (GenBank Accession No. AF309556) in *Saccharomyces cerevisiae* showed bifunctional Δ6 and Δ5 desaturase activity with a distinct preference for ω-3 compared with ω-6 substrates and slightly higher Δ6 than Δ5 desaturase activity. Subsequently, the Applicants identified GenBank Accession No. BC068224 as a homolog of GenBank Accession No. AF309556, that differed by a 1 bp (T) deletion at position 984 of the ORF (resulting in a null mutation) and a 1 bp substituion (G to A) at position 1171 (resulting in a V to M amino acid change). A mutant protein was then created (identified herein as "Drd6/d5(M)") identical to the protein encoded by GenBank Accession No. AF309556, with the exception of the V1171M mutation. Although preliminary studies by the Applicants herein determined that expression of Drd6/d5(M) in *S. cerevisiae* showed about 50% less activity than GenBank Accession No. AF309556, expression in a *Yarrowia* strain making ETA confirmed Drd6/d5(M) was much more ω-3-specific. Thus, this enzyme (identified herein as SEQ ID NO:373), or one with similar substrate specificity, is desirable upon expression of either the ω-3 Δ6 desaturase/Δ6 elongase pathway or the ω-3 Δ9 elongase/Δ8 desaturase pathway for increased synthesis of ω-3 PUFAs.

Of course, in alternate embodiments of the present invention, other DNAs which are substantially identical to the desaturases and elongases encoded by SEQ ID NOs:2, 5, 7, 9, 12, 15, 18, 21, 24, 26, 28, 30-32, 34, 36, 38, 40, 42, 44, 46, 48, 50, 58, 64, 67, 75, 78, 370, 373, 375, 376, 378-380, 382 and 384-388 also can be used for production of EPA in *Yarrowia lipolytica*. By "substantially identical" is intended an amino acid sequence or nucleic acid sequence exhibiting in order of increasing preference at least 80%, 90% or 95% homology to the selected polypeptides, or nucleic acid sequences encoding the amino acid sequence. For polypeptides, the length of comparison sequences generally is at least 16 amino acids, preferably at least 20 amino acids or most preferably 35 amino acids. For nucleic acids, the length of comparison sequences generally is at least 50 nucleotides, preferably at least 60 nucleotides, more preferably at least 75 nucleotides, and most preferably 110 nucleotides.

Homology typically is measured using sequence analysis software, wherein the term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.* 215:403-410 (1990)); 3.) DNASTAR (DNASTAR, Inc., Madison, Wis.); and 4.) the FASTA program incorporating the Smith-Waterman algorithm (W. R. Pearson, *Comput. Methods Genome Res.*, [Proc. Int. Symp.] (1994), Meeting Date 1992, 111-20. Suhai, Sandor, Ed. Plenum: New York, N.Y.). Within the context of this application it will be understood that where sequence analysis software is used for analysis, the results of the analysis will be based on the "default values" of the program referenced, unless otherwise specified. As used herein "default values" will mean any set of values or parameters that originally load with the software when first initialized. In general, such computer software matches similar sequences by assigning degrees of homology to various substitutions, deletions, and other modifications.

In more preferred embodiments, codon-optimized genes encoding desaturases and elongases that are substantially identical to those described in SEQ ID NOs:2, 9, 12, 15, 18, 21, 50, 58 and 64 are utilized. Specifically, as is well known to one of skill in the art, the expression of heterologous genes can be increased by increasing the translational efficiency of encoded mRNAs by replacement of codons in the native gene with those for optimal gene expression in the selected host microorganism. Thus, it is frequently useful to modify a portion of the codons encoding a particular polypeptide that is to be expressed in a foreign host, such that the modified polypeptide uses codons that are preferred by the alternate host, and, use of host preferred codons can substantially enhance the expression of the foreign gene encoding the polypeptide.

In general, host preferred codons can be determined within a particular host species of interest by examining codon usage in proteins (preferably those expressed in the largest amount) and determining which are used with highest frequency. Then, the coding sequence for a polypeptide of interest (e.g., a desaturase, elongase, acyltransferase) can be synthesized in whole or in part using the codons preferred in the host species. All (or portions) of the DNA also can be synthesized to remove any destabilizing sequences or regions of secondary structure that would be present in the transcribed mRNA. All (or portions) of the DNA also can be synthesized to alter the base composition to one more preferable in the desired host cell.

Additionally, the nucleotide sequences surrounding the translational initiation codon 'ATG' have been found to affect expression in yeast cells. If the desired polypeptide is poorly expressed in yeast, the nucleotide sequences of exogenous genes can be modified to include an efficient yeast translation initiation sequence to obtain optimal gene expression. For expression in yeast, this can be done by site-directed mutagenesis of an inefficiently expressed gene by fusing it in-frame to an endogenous yeast gene, preferably a highly expressed gene. Alternatively, as demonstrated herein for *Yarrowia lipolytica*, one can determine the consensus translation initiation sequence in the host and engineer this sequence into heterologous genes for their optimal expression in the host of interest.

In the present invention, several desaturase and elongase genes from Table 5 were codon-optimized for expression in *Yarrowia lipolytica*, based on the host preferences described above. This was possible by first determining the *Y. lipolytica* codon usage profile (see WO 04/101757) and identifying those codons that were preferred. Then, for further optimization of gene expression in *Y. lipolytica*, the consensus sequence around the 'ATG' initiation codon was determined (i.e., 'MAMMATGNHS' (SEQ ID NO:368), wherein the nucleic acid degeneracy code used is as follows: M=A/C; S=C/G; H=A/C/T; and N=A/C/G/T). Table 7, below, compares the activity of native and codon-optimized genes when expressed in *Y. lipolytica* and provides details about each codon-optimized gene. % Sub. Conv. is the abbeviation for "percent substrate conversion" and Codon-Opt. is an abbreviation for "codon-optimized".

*lus, Rhodotorula* and *Entomophthora*. Within the genus *Porphyridium*, of particular interest is *P. cruentum*. Within the genus *Mortierella*, of particular interest are *M. elongata, M. exigua, M. hygrophila, M. ramanniana* var. *angulispora* and *M. alpina*. Within the genus *Mucor*, of particular interest are *M. circinelloides* and *M. javanicus*.

Alternatively, a related desaturase that is not substantially identical to the *M. alpina* Δ6 desaturase, for example, but which can desaturate a fatty acid molecule at carbon 6 from the carboxyl end of the molecule would also be useful in the present invention as a Δ6 desaturase, assuming the desaturase can still effectively convert LA to GLA and/or ALA to STA. As such, related desaturases and elongases can be identified

TABLE 7

Most Preferred Codon-Optimized Desaturases And Elongases For EPA Biosynthesis In *Yarrowia lipolytica*

| Native Gene | Native Gene % Sub. Conv. | Total Bases Modified In Codon-Opt. Gene | Codon-Opt. Gene % Sub. Conv. | Reference | Codon-Opt. SEQ ID NO |
|---|---|---|---|---|---|
| *M. alpina* Δ6 desaturase (GenBank Accession No. AF465281) | 30% | 152 of 1374 bp (corresponding to 144 codons) | 42% | WO 04/101753 | 3 |
| *M. alpina* high affinity C$_{18/20}$ elongase (GenBank Accession No. AX464731) | 30% | 94 of 957 bp (corresponding to 85 codons) | 47% | WO 04/101753 | 19 |
| *T. aureum* C$_{18/20}$ elongase ("ELO2") | 33% | 114 of 817 bp (corresponding to 108 codons) | 46% | — | 22 |
| *S. diclina* Δ17 desaturase (US 2003/0196217 A1) | 23% | 127 of 1077 bp (corresponding to 117 codons) | 45% | Co-Pending U.S. Patent Application No. 10/840478 | 16 |
| *Isochrysis galbana* Δ9 elongase | — | 126 of 789 bp (corresponding to 123 codons) | 30% | — | 51 |
| *Euglena gracillis* Δ8 desaturase | — | 207 of 1263 bp (corresponding to 192 codons) | 75% | Co-pending U.S. Patent Application No. 11/166993 | 61 |
| *Isochrysis galbana* Δ5 desaturase | 7% | 203 of 1323 bp (corresponding to 193 codons) | 32% | — | 10 |
| *Homo sapiens* Δ5 desaturase (GenBank Accession No. NP_037534) | — | 227 of 1335 bp (corresponding to 207 codons) | 30% | — | 13 |
| *Rattus norvegicus* C$_{16/18}$ elongase (GenBank Accession No. AB071986) | — | 127 of 792 bp (corresponding to 125 codons) | 43% | — | 65 |

In additional alternate embodiments of the invention, other DNAs which, although not substantially identical to the preferred desaturases and elongases presented as SEQ ID NOs:3, 10, 13, 16, 19, 22, 51, 61 and 65 also can be used for the purposes herein. For example, DNA sequences encoding Δ6 desaturase polypeptides that would be useful for introduction into *Yarrowia lipolytica* according to the teachings of the present invention may be obtained from microorganisms having an ability to produce GLA or STA. Such microorganisms include, for example, those belonging to the genera *Mortierella, Conidiobolus, Pythium, Phytophathora, Penicillium, Porphyridium, Coidosporium, Mucor, Fusarium, Aspergil-* (or created) by their ability to function substantially the same as the desaturases and elongases disclosed herein.

As suggested above, in another embodiment one skilled in the art could create a fusion protein having e.g., both Δ12 desaturase and Δ6 desaturase activities suitable for the purposes herein. This would be possible by fusing together a Δ12 desaturase and Δ6 desaturase with an adjoining linker. Either the Δ12 desaturase or the Δ6 desaturase could be at the N-terminal portion of the fusion protein. Means to design and synthesize an appropriate linker molecule are readily known by one of skill in the art, for example, the linker can be a stretch of alanine or lysine amino acids and will not affect the fusion enzyme's activity.

Finally, it is well known in the art that methods for synthesizing sequences and bringing sequences together are well established in the literature. Thus, in vitro mutagenesis and selection, site-directed mutagenesis, chemical mutagenesis, "gene shuffling" methods or other means can be employed to obtain mutations of naturally occurring desaturase and/or elongase genes. This would permit production of a polypeptide having desaturase or elongase activity, respectively, in vivo with more desirable physical and kinetic parameters for functioning in the host cell (e.g., a longer half-life or a higher rate of production of a desired PUFA).

In summary, although sequences of preferred desaturase and elongase genes are presented that encode PUFA biosynthetic pathway enzymes suitable for EPA production in *Yarrowia lipolytica*, these genes are not intended to be limiting to the invention herein. Numerous other genes encoding PUFA biosynthetic pathway enzymes that would be suitable for the purposes herein could be isolated from a variety of sources (e.g., a wildtype, codon-optimized, synthetic and/or mutant enzyme having appropriate desaturase or elongase activity). These alternate desaturases would be characterized by the ability to: 1.) desaturate a fatty acid between the $17^{th}$ and $18^{th}$ carbon atom numbered from the carboxyl-terminal end of the molecule and catalyze the conversion of ARA to EPA and/or DGLA to ETA ($\Delta17$ desaturases); 2.) catalyze the conversion of LA to GLA and/or ALA to STA ($\Delta6$ desaturases); 3.) catalyze the conversion of DGLA to ARA and/or ETA to EPA ($\Delta5$ desaturases); 4.) catalyze the conversion of oleic acid to LA ($\Delta12$ desaturases); 5.) catalyze the conversion of LA to ALA ($\Delta15$ desaturases); 6.) catalyze the conversion of EDA to DGLA and/or ETrA to ETA ($\Delta8$ desaturases); and/or 7.) catalyze the conversion of palmitate to palmitoleic acid and/or stearate to oleic acid ($\Delta9$ desaturases). In like manner, suitable elongases for the purposes herein are not limited to those from a specific source. Instead, the enzymes having use for the purposes herein are characterized by their ability to elongate a fatty acid carbon chain by 2 carbons relative to the substrate the elongase acts upon, to thereby produce a mono- or polyunsaturated fatty acid. More specifically, these elongases would be characterized by the ability to: 1.) elongate LA to EDA and/or ALA to ETrA ($\Delta9$ elongases); 2.) elongate a C18 substrate to produce a C20 product ($C_{18/20}$ elongases); 3.) elongate a C14 substrate to produce a C16 product ($C_{14/16}$ elongases); and/or 4.) elongate a C16 substrate to produce a C18 product ($C_{16/18}$ elongases). Again, it is important to note that some elongases may be capable of catalyzing several elongase reactions, as a result of broad substrate specificity.

Acyltransferases and their Role in the Terminal Step of TAG Biosynthesis

Acyltransferases are intimately involved in the biosynthesis of TAGs. Two comprehensive mini-reviews on TAG biosynthesis in yeast, including details concerning the genes involved and the metabolic intermediates that lead to TAG synthesis are: D. Sorger and G. Daum, *Appl. Microbiol. Biotechnol.* 61:289-299 (2003); and H. Müllner and G. Daum, *Acta Biochimica Polonica*, 51 (2):323-347 (2004). Although the authors of these reviews clearly summarize the different classes of eukaryotic acyltransferase gene families (infra), they also acknowledge that regulatory aspects of TAG synthesis and formation of neutral lipids in lipid particles remain far from clear.

Four eukaryotic acyltransferase gene families have been identified which are involved in acyl-CoA-dependent or independent esterification reactions leading to neutral lipid synthesis:

(1) The acyl-CoA:cholesterol acyltransferase (ACAT) family, EC 2.3.1.26 (commonly known as sterol acyltransferases). This family of genes includes enzymes responsible for the conversion of acyl-CoA and sterol to CoA and sterol esters. This family also includes DGAT1, involved in the terminal step of TAG biosynthesis.

(2) The lecithin:cholesterol acyltransferase (LCAT) family, EC 2.3.1.43. This family of genes is responsible for the conversion of phosphatidylcholine and a sterol to a sterol ester and 1-acylglycerophosphocholine. This family also includes the phospholipid:diacylglycerol acyltransferase (PDAT) enzyme involved in the transfer of an acyl group from the sn-2 position of a phospholipid to the sn-3 position of 1,2-diacylglycerol resulting in TAG biosynthesis.

(3) The diacylglycerol acyltransferase (DAG AT) family, EC 2.3.1.20. This family of genes (which includes DGAT2) is involved in the terminal step of TAG biosynthesis.

(4) The glycerol-3-phosphate acyltransferase and acyl-CoA lysophosphatidic acid acyltransferase (GPAT/LPAAT) family. GPAT (E.C. 2.3.1.15) proteins are responsible for the first step of TAG biosynthesis, while LPAAT (E.C. 2.3.1.51) enzymes are involved in the second step of TAG biosynthesis. This family also includes lysophosphatidylcholine acyltransferase (LPCAT) that catalyzes the acyl exchange between phospholipid and CoA.

Together, these 4 acyltransferase gene families represent overlapping biosynthetic systems for neutral lipid formation and appear to be the result of differential regulation, alternate localization, and different substrate specificities (H. Müllner and G. Daum, supra). Each of these four gene families will be discussed herein based on their importance with respect to metabolic engineering in *Yarrowia lipolytica*, to enable synthesis of greater than 25% EPA.

The Functionality of Various Acyltransferases

Figure 4A:
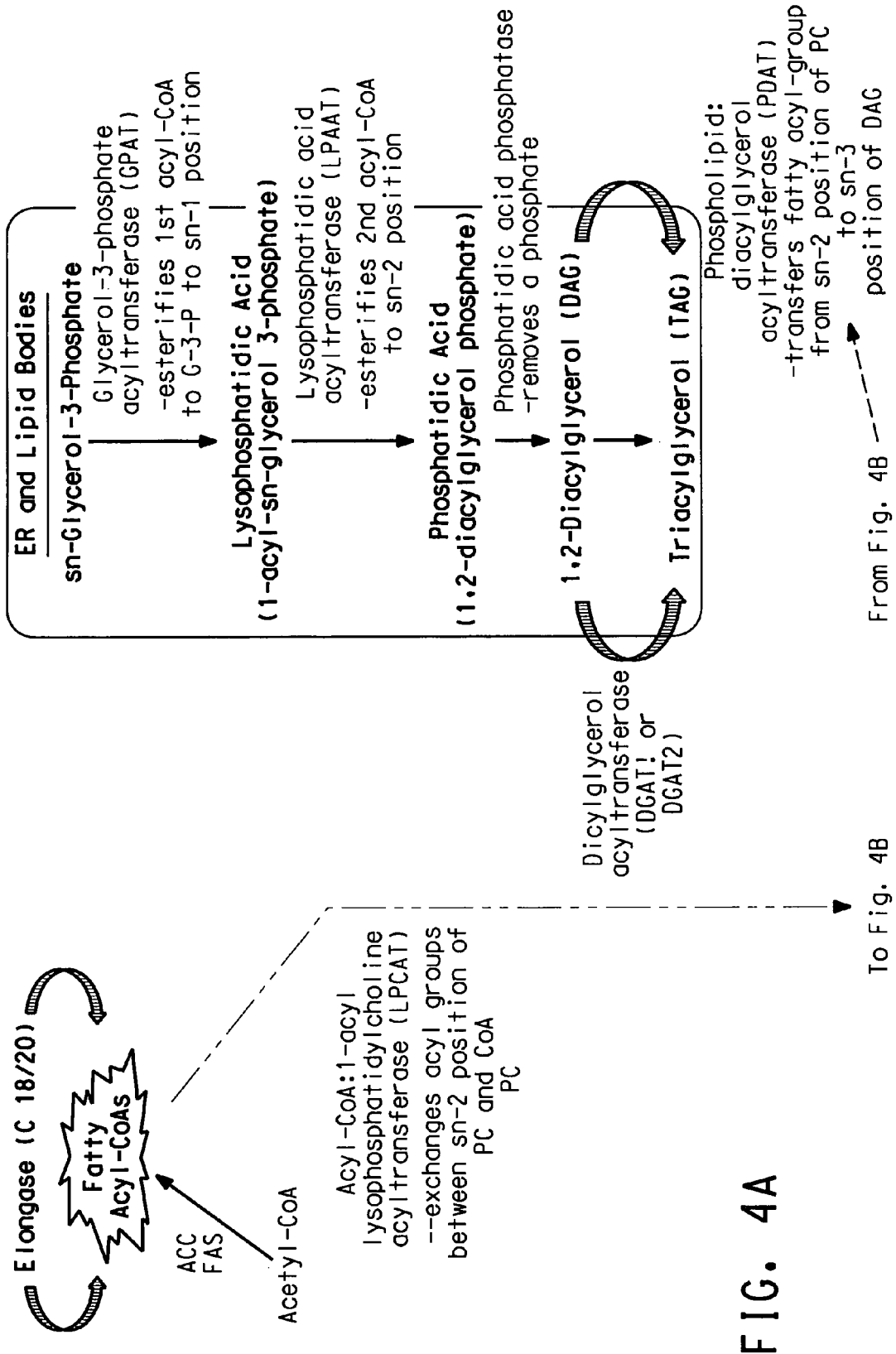
FIG. 4 is a schematic illustration describing the role of various acyltransferases in lipid accumulation in oleaginous yeast.
Figure 4B:
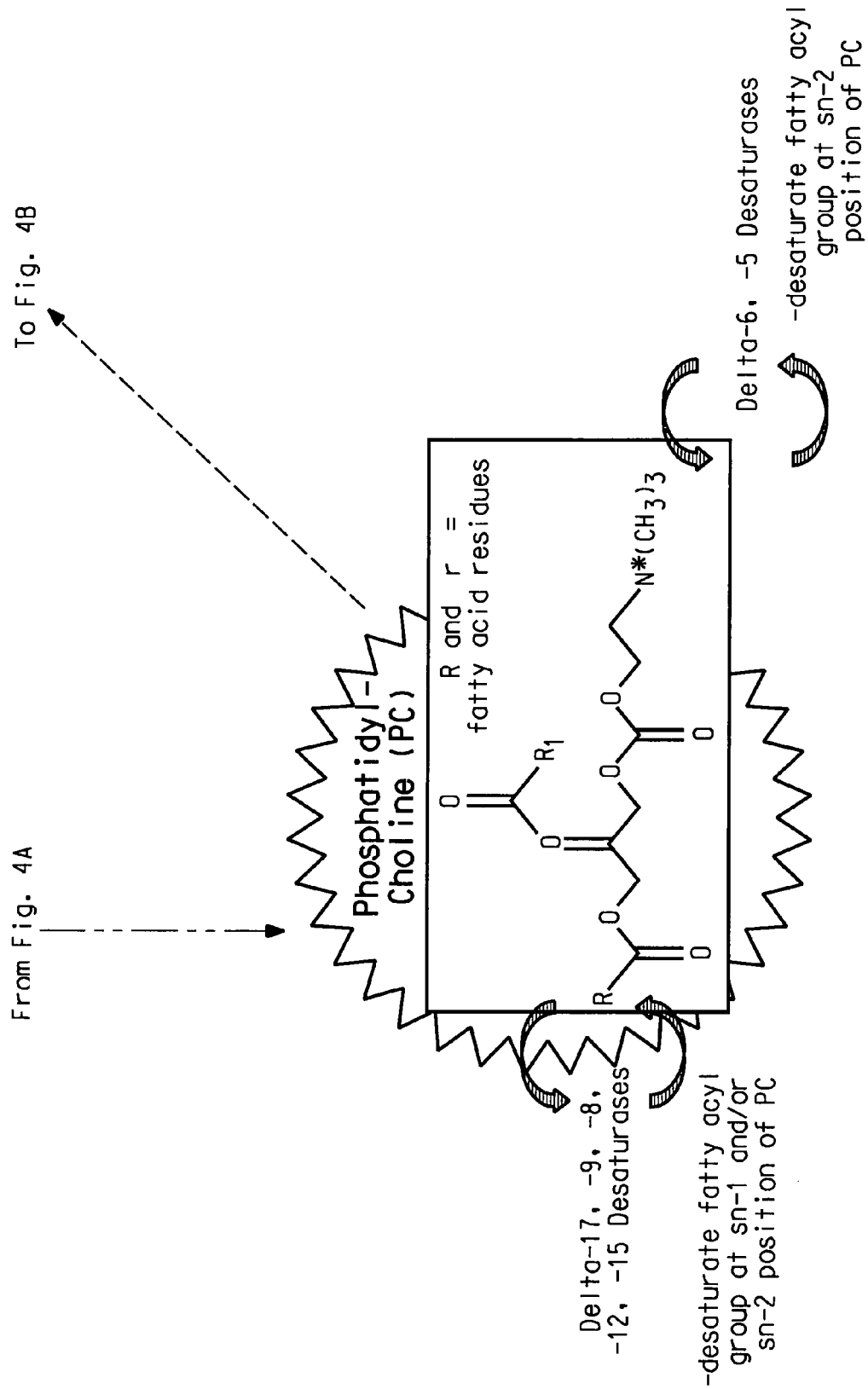

The interplay between many of these acyltransferases in *Yarrowia lipolytica* is schematically diagrammed in FIG. 4. Focusing initially on the direct mechanism of TAG biosynthesis, the first step in this process is the esterification of one molecule of acyl-CoA to sn-glycerol-3-phosphate via GPAT to produce lysophosphatidic acid (LPA) (and CoA as a by-product). Then, lysophosphatidic acid is converted to phosphatidic acid (PA) (and CoA as a by-product) by the esterification of a second molecule of acyl-CoA, a reaction that is catalyzed by LPAAT. Phosphatidic acid phosphatase is then responsible for the removal of a phosphate group from phosphatidic acid to yield 1,2-diacylglycerol (DAG). Subsequently a third fatty acid is added to the sn-3 position of DAG by a DAG AT (e.g., DGAT1, DGAT2 or PDAT) to form TAG.

Historically, DGAT1 was thought to be the only enzyme specifically involved in TAG synthesis, catalyzing the reaction responsible for the conversion of acyl-CoA and DAG to TAG and CoA, wherein an acyl-CoA group is transferred to DAG to form TAG. DGAT1 was known to be homologous to ACATs; however, recent studies have identified a new family of DAG AT enzymes that are unrelated to the ACAT gene family. Thus, nomenclature now distinguishes between the DAG AT enzymes that are related to the ACAT gene family (DGAT1 family) versus those that are unrelated (DGAT2 family) (Lardizabal et al., *J. Biol. Chem.* 276(42):38862-38869 (2001)). Members of the DGAT2 family have been identified in all major phyla of eukaryotes (fungi, plants, animals and basal eukaryotes).

Even more recently, Dahlqvist et al. (*Proc. Nat. Acad. Sci.* (USA) 97:6487-6492 (2000)) and Oelkers et al. (*J. Biol. Chem.* 275:15609-15612 (2000)) discovered that TAG synthesis can also occur in the absence of acyl-CoA, via an acyl-CoA-independent mechanism. Specifically, PDAT removes an acyl group from the sn-2 position of a phosphotidylcholine substrate for transfer to DAG to produce TAG.

This enzyme is structurally related to the LCAT family; and although the function of PDAT is not as well characterized as DGAT2, PDAT has been postulated to play a major role in removing "unusual" fatty acids from phospholipids in some oilseed plants (Banas, A. et al., *Biochem. Soc. Trans.* 28(6): 703-705 (2000)).

With respect to TAG synthesis in *Saccharomyces cerevisiae*, three pathways have been described (Sandager, L. et al., *J. Biol. Chem.* 277(8):6478-6482 (2002)). First, TAGs are mainly synthesized from DAG and acyl-CoAs by the activity of DGAT2 (encoded by the DGA1 gene). More recently, however, a PDAT (encoded by the LRO1 gene) has also been identified. Finally, two acyl-CoA:sterol-acyltransferases (encoded by the ARE1 and ARE2 genes) are known that utilize acyl-CoAs and sterols to produce sterol esters (and TAGs in low quantities; see Sandager et al., *Biochem. Soc. Trans.* 28(6):700-702 (2000)). Together, PDAT and DGAT2 are responsible for approximately 95% of oil biosynthesis in *S. cerevisiae*.

Based on several publicly available sequences encoding DGAT1s, DGAT2s, PDATs and ARE2s (infra), the Applicants isolated and characterized the genes encoding DGAT1 (SEQ ID NO:94), DGAT2 (SEQ ID NOs:102, 104 and 106 [wherein SEQ ID NO:102 contains at least two additional nested ORFs as provided in SEQ ID NOs:104 and 106; the ORF encoded by SEQ ID NO: 106 has a high degree of similarity to other known DGAT enzymes and disruption in SEQ ID NO:106 eliminated DGAT function of the native gene, thereby confirming that the polypeptide of SEQ ID NO:107 has DGAT functionality]), PDAT (SEQ ID NO:89) and ARE2 (SEQ ID NO:91) in *Yarrowia lipolytica*. In contrast to the model developed in *S. cerevisiae*, wherein PDAT and DGAT2 are responsible for approximately 95% of oil biosynthesis, however, it was discovered that the PDAT, DGAT2 and DGAT1 of *Yarrowia lipolytica* are responsible for up to ~95% of oil biosynthesis (while ARE2 may additionally be a minor contributor to oil biosynthesis).

The final acyltransferase enzyme whose function could be important in the accumulation of EPA in the TAG fraction of *Yarrowia lipolytica* is LPCAT. As shown in FIG. 4, this enzyme (EC 2.3.1.23) is hypothesized to be responsible for two-way acyl exchange at the sn-2 position of sn-phosphatidylcholine to enhance ω-6 and ω-3 PUFA biosynthesis. This hypothesis is based on the following studies: (1) Stymne S. and A. K. Stobart (*Biochem J.* 223(2):305-14(1984)), who hypothesized that LPCAT affected exchange between the acyl-CoA pool and phosphatidylcholine (PC) pool; (2) Domergue, F. et al. (*J. Bio. Chem* 278:35115 (2003)), who suggested that accumulation of GLA at the sn-2 position of PC and the inability to efficiently synthesize ARA in yeast was a result of the elongation step involved in PUFA biosynthesis occurring within the acyl-CoA pool, while Δ5 and Δ6 desaturation steps occurred predominantly at the sn-2 position of PC; (3) Abbadi, A. et al. (*The Plant Cell*, 16:2734-2748 (2004)), who suggested that LPCAT plays a criticial role in the successful reconstitution of a Δ6 desaturase/Δ6 elongase pathway, based on analysis on the constraints of PUFA accumulation in transgenic oilseed plants; and, (4) WO 2004/076617A2 (Renz, A. et al.), who provided a gene encoding LPCAT from *Caenorhabditis elegans* (T06E8.1) that substantially improved the efficiency of elongation in a genetically introduced Δ6 desaturase/Δ6 elongase pathway in *S. cerevisiae*. The inventors concluded that LPCAT allowed efficient and continuous exchange of the newly synthesized fatty acids between phospholipids and the acyl-CoA pool, since desaturases catalyze the introduction of double bonds in lipid-coupled fatty acids (sn-2 acyl PC) while elongases exclusively catalyze the elongation of CoA esterified fatty acids (acyl-CoAs).

Selection of Heterologous Acyltransferase Genes For EPA Synthesis

Since naturally produced PUFAs in *Yarrowia lipolytica* are limited to 18:2 fatty acids (and less commonly, 18:3 fatty acids), it would be likely that the host organism's native genes encoding GPAT, LPAAT (i.e., LPAAT1 or LPAAT2), DGAT1, DGAT2, PDAT and LPCAT could have difficulty efficiently synthesizing TAGs comprising fatty acids that were 18:3 and greater in length (e.g., EPA). Thus, in some cases, a heterologous (or "foreign") acyltransferase could be preferred over a native enzyme.

Numerous acyltransferase genes have been identified in various organisms and disclosed in the public and patent literature. For instance, the following GenBank Accession Numbers refer to examples of publicly available acyltransferase genes useful in lipid biosynthesis: CQ891256, AY441057, AY360170, AY318749, AY093169, AJ422054, AJ311354, AF251795, Y00771, M77003 (GPATs); Q93841, Q22267, Q99943, O15120, Q9NRZ7, Q9NRZ5, Q9NUQ2, O35083, Q9D1E8, Q924S1, Q59188, Q42670, P26647, P44848, Q9ZJN8, O25903 Q42868, Q42870, P26974, P33333, Q9XFW4, CQ891252, CQ891250, CQ891260, CQ891258, CQ891248, CQ891245, CQ891241, CQ891238, CQ891254, CQ891235 (LPAATs); AY445635, BC003717, NM_010046, NM_053437, NM_174693, AY116586, AY327327, AY327326, AF298815 and AF164434 (DGAT1s); and NC_001147 [locus NP_014888], NM_012079, NM_127503, AF051849, AJ238008, NM_026384, NM_010046, AB057816, AY093657, AB062762, AF221132, AF391089, AF391090, AF129003, AF251794 and AF164434 (DGAT2s); P40345, O94680, NP_596330, NP_190069 and AB006704 [gi:2351069] (PDATs). Similarly, the patent literature provides many additional DNA sequences of genes (and/or details concerning several of the genes above and their methods of isolation) involved in TAG production [e.g., U.S. Pat. No. 5,210,189, WO 2003/025165 (GPATs); EP1144649A2, EP1131438, U.S. Pat. No. 5,968,791, U.S. Pat. No. 6,093,568, WO 2000/049156 and WO 2004/087902 (LPMTs); U.S. Pat. No. 6,100, 077, U.S. Pat. No. 6,552,250, U.S. Pat. No. 6,344,548, US 2004/0088759A1 and US 20040078836A1 (DGAT1s); US 2003/124126, WO 2001/034814, US 2003/115632, US 2003/0028923 and US 2004/0107459 (DGAT2s); WO 2000/060095 (PDATs); and WO 2004/076617A2 (LPCATs).

The examples above are not intended to be limiting and numerous other genes encoding DGAT1, DGAT2, PDAT, GPAT, LPCAT and LPAAT derived from different sources would be suitable for introduction into *Yarrowia lipolytica*. For example, the Applicants have identified novel DGAT1s from *Mortierella alpina* (SEQ ID NOs:96 and 97), *Neurospora crassa* (SEQ ID NO:98), *Gibberella zeae* PH-1 (SEQ ID NO:99), *Magnaporthe grisea* (SEQ ID NO:100) and *Aspergillus nidulans* (SEQ ID NO:101); and, a novel DGAT2 (SEQ ID NOs:108 and 109), GPAT (SEQ ID NOs:110 and 111), LPAAT1 (SEQ ID NOs:80 and 81) and LPAAT2 (SEQ ID NOs:82 and 83) from *Mortierella alpina*.

Preferred Acyltransferase Genes for EPA Synthesis

Despite the wide selection of acyltransferases that could be suitable for expression in *Yarrowia lipolytica*, however, in preferred embodiments of the present invention the DGAT1, DGAT2, PDAT, GPAT, LPAAT and LPCAT are selected from organisms producing significant amounts of longer chain ω-6

(e.g., ARA) and/or ω-3 (e.g., EPA, DHA) PUFAs. Thus, the following enzymes are especially preferred (or derivatives thereof):

TABLE 8

Preferred Heterologous Acyltransferases For Expression In A High EPA-Producing Strain Of *Yarrowia lipolytica*

| ORF | Organism | Reference | SEQ ID NOs |
|---|---|---|---|
| DGAT1 | *Mortierella alpina* | Co-pending U.S. Patent Application Number 11/024544 | 96, 97 |
| DGAT2 | *Mortierella alpina* | Co-pending U.S. Patent Application Number 11/024545 | 108, 109 |
| GPAT | *Mortierella alpina* | — | 110, 111 |
| LPAAT1 | *Mortierella alpina* | — | 80, 81 |
| LPAAT2 | *Mortierella alpina* | Co-pending U.S. Patent Application Number 60/689031 | 82, 83 |
| LPCAT | *Caenorhabditis elegans* | Clone T06E8.1; WO 2004/076617 A2 | 93 |

Although not intended to be limiting in the invention herein, *M. alpina* was selected as a preferred source of heterologous acyltransferases since the native organism is capable of synthesizing ARA at concentrations greater than 50% of the total fatty acids (TFAs). In similar manner, *C. elegans* can produce up to 20-30% of its TFAs as EPA.

Of course, in alternate embodiments of the present invention, other DNAs which are substantially identical to the acyltransferases encoded by SEQ ID NOs:80-83, 93, 96, 97 and 108-111 also can be used for heterologous expression in *Yarrowia lipolytica* to facilitate the production and accumulation of EPA in the TAG fraction. In more preferred embodiments, codon-optimized genes encoding acyltransferases that are substantially identical to those described in SEQ ID NOs: 80-83, 93, 96, 97 and 108-111 are utilized.

General Expression Systems, Cassettes, Vectors and Transformation For Expression of Foreign Genes Microbial expression systems and expression vectors containing regulatory sequences that direct high-level expression of foreign proteins such as those leading to the high-level production of EPA are well known to those skilled in the art. Any of these could be used to construct chimeric genes encoding the preferred desaturases, elongases and acyltransferases. These chimeric genes could then be introduced into *Yarrowia lipolytica* using standard methods of transformation to provide high-level expression of the encoded enzymes.

Vectors or DNA cassettes useful for the transformation of host cells are well known in the art. The specific choice of sequences present in the construct is dependent upon the desired expression products, the nature of the host cell, and the proposed means of separating transformed cells versus non-transformed cells. Typically, however, the vector or cassette contains sequences directing transcription and translation of the relevant gene(s), a selectable marker and sequences allowing autonomous replication or chromosomal integration. Suitable vectors comprise a region 5' of the gene that controls transcriptional initiation (e.g., a promoter) and a region 3' of the DNA fragment that controls transcriptional termination (i.e., a terminator). It is most preferred when both control regions are derived from genes from the transformed host cell, although it is to be understood that such control regions need not be derived from the genes native to the specific species chosen as a production host.

Where two or more genes are expressed from separate replicating vectors, it is desirable that each vector has a different means of selection and should lack homology to the other constructs to maintain stable expression and prevent reassortment of elements among constructs. Judicious choice of regulatory regions, selection means and method of propagation of the introduced construct can be experimentally determined so that all introduced genes are expressed at the necessary levels to provide for synthesis of the desired products.

Constructs comprising the gene(s) of interest may be introduced into a host cell by any standard technique. These techniques include transformation (e.g., lithium acetate transformation [*Methods in Enzymology*, 194:186-187 (1991)]), protoplast fusion, bolistic impact, electroporation, microinjection, or any other method that introduces the gene(s) of interest into the host cell. More specific teachings applicable for *Yarrowia lipolytica* include U.S. Pat. No. 4,880,741 and No. 5,071,764 and Chen, D. C. et al. (*Appl Microbiol Biotechnol.* 48(2):232-235 (1997)).

For convenience, a host cell that has been manipulated by any method to take up a DNA sequence (e.g., an expression cassette) will be referred to as "transformed" or "recombinant" herein. The transformed host will have at least one copy of the expression construct and may have two or more, depending upon whether the gene is integrated into the genome, amplified, or is present on an extrachromosomal element having multiple copy numbers. The transformed host cell can be identified by various selection techniques, as described in WO 2004/101757 and WO2005/003310.

Preferred selection methods for use herein are resistance to kanamycin, hygromycin and the amino glycoside G418, as well as ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura⁻ mutants. The compound is toxic to yeast cells that possess a functioning URA3 gene encoding orotidine 5'-monophosphate decarboxylase (OMP decarboxylase); thus, based on this toxicity, 5-FOA is especially useful for the selection and identification of Ura⁻ mutant yeast strains (Bartel, P. L. and Fields, S., Yeast 2-Hybrid System, Oxford University: New York, v. 7, pp 109-147, 1997).

An alternate preferred selection method utilized herein relies on a dominant, non antibiotic marker for *Yarrowia lipolytica* based on sulfonylurea resistance. The technique is also generally applicable to other industrial yeast strains that may be haploid, diploid, aneuploid or heterozygous. It is expected to overcome two main limitations to the development of genetic transformation systems for industrial yeast strains, wherein: (1) there are almost no naturally auxotrophic strains, and the isolation of spontaneous or induced auxotrophic mutants is hindered by the ploidy of the strains; and, (2) the use of antibiotic resistance markers may limit the commercial application of strains due to restrictions on the release of genetically modified organisms carrying antibiotic resistance genes. Although Puig et al. (*J. Agric. Food Chem.* 46:1689-1693 (1998)) developed a method to overcome these limitations based on the genetic engineering of a target strain in order to make it auxotrophic for uridine and the subsequent use of the URA3 marker in order to introduce traits of interest, this strategy was deemed too laborious for routine work.

The new sulfonylurea resistance selection marker disclosed herein for transforming *Yarrowia lipolytica* does not rely on a foreign gene but on a mutant native gene. Thus, it neither requires auxotrophy nor results in auxotrophy and allows transformation of wild type strains. More specifically, the marker gene (SEQ ID NO:292) is a native acetohydroxyacid synthase (AHAS or acetolactate synthase; E.C. 4.1.3.18)

that has a single amino acid change (W497L) that confers sulfonyl urea herbicide resistance. AHAS is the first common enzyme in the pathway for the biosynthesis of branched-chain amino acids and it is the target of the sulfonylurea and imidazolinone herbicides. The W497L mutation has been reported in *Saccharomyces cerevisiae* (Falco, S. C., et al., *Dev. Ind. Microbiol.* 30:187-194 (1989); Duggleby, R.G., et. al. *Eur. J. Biochem.* 270:2895 (2003)). Initial testing determined that *Yarrowia* cells were not naturally resistant to the herbicide as a result of: 1.) poor or no uptake of the herbicide; 2.) the presence of a native herbicide-resistant form of AHAS; and/or 3.) use of a herbicide-inactivating mechanism. This thereby enabled synthesis and use of the mutant AHAS gene (SEQ ID NO:292) as a means for selection of transformants.

An additional method for recycling a selection marker relies on site-specific recombinase systems. Briefly, the site-specific recombination system consists of two elements: (1) a recombination site having a characteristic DNA sequence [e.g., LoxP]; and (2) a recombinase enzyme that binds to the DNA sequence specifically and catalyzes recombination (i.e., excision) between DNA sequences when two or more of the recombination sites are oriented in the same direction at a given interval on the same DNA molecule [e.g., Cre]. This methodology has utility as a means of selection, since it is possible to "recycle" a pair of preferred selection markers for their use in multiple sequential transformations.

Specifically, an integration construct is created comprising a target gene that is desirable to insert into the host genome (e.g., a desaturase, elongase, acyltransferase), as well as a first selection marker (e.g., Ura3, hygromycin phosphotransferase [HPT]) that is flanked by recombination sites. Following transformation and selection of the transformants, the first selection marker is excised from the chromosome by the introduction of a replicating plasmid carrying a second selection marker (e.g., sulfonylurea resistance [AHAS]) and a recombinase suitable to recognize the site-specific recombination sites introduced into the genome. Upon selection of those transformants carrying the second marker and confirmation of excision of the first selection marker from the host genome, the replicating plasmid is then cured from the host in the absence of selection. This produces a transformant that possesses neither the first nor second selection marker, and thus the cured strain is available for another round of transformation. One skilled in the art will recognize that the methodology is not limited to the particular selection markers or site-specific recombination system used in the present invention.

Overexpression of Foreign Genes in *Yarrowia lipolytica*

As is well known to one of skill in the art, merely inserting a gene (e.g., a desaturase) into a cloning vector does not ensure that it will be successfully expressed at the level needed. It may be desirable to manipulate a number of different genetic elements that control aspects of transcription, translation, protein stability, oxygen limitation and secretion from the host cell. More specifically, gene expression may be controlled by altering the following: the nature of the relevant transcriptional promoter and terminator sequences; the number of copies of the cloned gene; whether the gene is plasmid-borne or integrated into the genome of the host cell; the final cellular location of the synthesized foreign protein; the efficiency of translation in the host organism; the intrinsic stability of the cloned gene protein within the host cell; and the codon usage within the cloned gene, such that its frequency approaches the frequency of preferred codon usage of the host cell. Several of these methods of overexpression will be discussed below, and are useful in the present invention as a means to overexpress e.g., desaturases, elongases and acyltransferases in *Yarrowia lipolytica*.

Expression of the desired gene(s) can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141).

Initiation control regions or promoters which are useful to drive expression of desaturase, elongase and acyltransferase genes in the desired host cell are numerous and familiar to those skilled in the art. Virtually any promoter capable of directing expression of these genes in *Yarrowia lipolytica* is suitable for the present invention. Expression in the host cell can be accomplished in a transient or stable fashion. Transient expression can be accomplished by inducing the activity of a regulatable promoter operably linked to the gene of interest; alternatively, stable expression can be achieved by the use of a constitutive promoter operably linked to the gene of interest. As an example, when the host cell is yeast, transcriptional and translational regions functional in yeast cells are provided, particularly from the host species. The transcriptional initiation regulatory regions can be obtained, for example, from: 1.) genes in the glycolytic pathway, such as alcohol dehydrogenase, glyceraldehyde-3-phosphate-dehydrogenase, phosphoglycerate mutase, fructose-bisphosphate aldolase, phosphoglucose-isomerase, phosphoglycerate kinase, glycerol-3-phosphate O-acyltransferase, etc.; or 2.) regulatable genes, such as acid phosphatase, lactase, metallothionein, glucoamylase, the translation elongation factor EF1-α (TEF) protein (U.S. Pat. No. 6,265,185), ribosomal protein S7 (U.S. Pat. No. 6,265,185), ammonium transporter proteins, export proteins, etc. Any one of a number of regulatory sequences can be used, depending upon whether constitutive or induced transcription is desired, the efficiency of the promoter in expressing the ORF of interest, the ease of construction and the like. The examples provided above are not intended to be limiting in the invention herein.

As one of skill in the art is aware, a variety of methods are available to compare the activity of various promoters. This type of comparison is useful to facilitate a determination of each promoter's strength for use in future applications wherein a suite of promoters would be necessary to construct chimeric genes useful for the production of ω-6 and ω-3 fatty acids. Thus, it may be useful to indirectly quantitate promoter activity based on reporter gene expression (i.e., the *E. coli* gene encoding β-glucuronidase (GUS)). In alternate embodiments, it may sometimes be useful to quantify promoter activity using more quantitative means. One suitable method is the use of real-time PCR (for a general review of real-time PCR applications, see Ginzinger, D. J., *Experimental Hematology*, 30:503-512 (2002)). Real-time PCR is based on the detection and quantitation of a fluorescent reporter. This signal increases in direct proportion to the amount of PCR product in a reaction. By recording the amount of fluorescence emission at each cycle, it is possible to monitor the PCR reaction during exponential phase where the first significant increase in the amount of PCR product correlates to the initial amount of target template. There are two general methods for the quantitative detection of the amplicon: (1) use of fluorescent probes; or (2) use of DNA-binding agents (e.g., SYBR-green I, ethidium bromide). For relative gene expression comparisons, it is necessary to use an endogenous control as an internal reference (e.g., a chromosomally encoded 16S rRNA gene), thereby allowing one to normalize for differences in the amount of total DNA added to each real-time PCR reaction. Specific methods for real-time PCR are well documented in the art. See, for example, the Real Time PCR Special Issue (*Methods*, 25(4):383-481 (2001)).

Following a real-time PCR reaction, the recorded fluorescence intensity is used to quantitate the amount of template by use of: 1.) an absolute standard method (wherein a known amount of standard such as in vitro translated RNA (cRNA) is used); 2.) a relative standard method (wherein known amounts of the target nucleic acid are included in the assay design in each run); or 3.) a comparative $C_T$ method ($\Delta\Delta C_T$)

for relative quantitation of gene expression (wherein the relative amount of the target sequence is compared to any of the reference values chosen and the result is given as relative to the reference value). The comparative $C_T$ method requires one to first determine the difference ($\Delta C_T$) between the $C_T$ values of the target and the normalizer, wherein: $\Delta C_T = C_T$ (target)$-C_T$ (normalizer). This value is calculated for each sample to be quantitated and one sample must be selected as the reference against which each comparison is made. The comparative $\Delta\Delta C_T$ calculation involves finding the difference between each sample's $\Delta C_T$ and the baseline's $\Delta C_T$, and then transforming these values into absolute values according to the formula $2^{-\Delta\Delta C_T}$.

Despite the wide selection of promoters that could be suitable for expression in *Yarrowia lipolytica*, however, in preferred embodiments of the present invention the promoters are selected from those shown below in Table 9 (or derivatives thereof).

wherein each promoter was used for creation of a chimeric gene possessing the *E. coli* gene encoding β-glucuronidase (GUS) as a reporter (Jefferson, R. A. *Nature.* 14; 342:837-838 (1989)) and a ~100 bp of the 3' region of the *Yarrowia* Xpr gene. GUS activity in each expressed construct was measured by histochemical and/or fluorometric assays (Jefferson, R. A. *Plant Mol. Biol. Reporter* 5:387-405 (1987)) and/or by use of Real Time PCR.

The YAT1 promoter is unique in that it is characterized by the Applicants as the first promoter identified within *Yarrowia* that is inducible under oleaginous conditions (i.e., nitrogen limitation). Specifically, although the YAT1 promoter is active in media containing nitrogen (e.g., up to about 0.5% ammonium sulfate), the activity of the promoter increases when the host cell is grown in nitrogen-limiting conditions (e.g., in medium containing very low levels of ammonium, or lacking ammonium). Thus, a preferred medium would be one

TABLE 9

Native Promoters Preferred For Overexpression In *Yarrowia lipolytica*

| Promoter Name | Location* | Native Gene | Activity "Rank" | Reference | SEQ ID NO |
|---|---|---|---|---|---|
| TEF | — | translation elongation factor EF1-α | 1 | U.S. Pat. No. 6,265,185 (Muller et al.); GenBank Accession No. AF054508 | 181 |
| GPD | −968 bp to +3 bp | glyceraldehyde-3-phosphate-dehydrogenase | 2 | WO 2005/003310 | 173 |
| GPM | −875 bp to +3 bp | phosphoglycerate mutase | 1 | WO 2005/003310 | 175 |
| FBA | −1001 bp to −1 bp | fructose-bisphosphate aldolase | 4 | WO 2005/049805 | 176 |
| FBAIN | −804 bp to +169 bp (including a 102 bp intron [+64 to +165]) | fructose-bisphosphate aldolase | 7 | WO 2005/049805 | 177 |
| FBAINm | −804 bp to +169 bp with modification*** | fructose-bisphosphate aldolase | 5 | WO 2005/049805 | 178 |
| GPDIN | −973 bp to +201 bp (including a 146 bp intron [+49 to +194]) | glyceraldehyde-3-phosphate-dehydrogenase | 3 | Co-pending U.S. Patent Application No. 11/183664 | 174 |
| GPAT | −1130 to +3 bp | glycerol-3-phosphate O-acyltransferase | 5 | Co-pending U.S. Patent Application No. 11/225354 | 179 |
| YAT1 | −778 to −1 bp | ammonium transporter enzyme | 6 | Co-pending U.S. Patent Application No. 11/185301 | 180 |
| EXP1 | −1000 to −1 bp | export protein | 6 | — | 389 |

*Location is with respect to the native gene, wherein the 'A' position of the 'ATG' translation initiation codon is designated as +1.
***The FBAINm promoter is a modified version of the FBAIN promoter, wherein FBAINm has a 52 bp deletion between the ATG translation initiation codon and the intron of the FBAIN promoter (thereby including only 22 amino acids of the N-terminus) and a new translation consensus motif after the intron. Furthermore, while the FBAIN promoter generates a fusion protein whenfused with the coding region of a gene to be expressed, the FBAINm promoter does not generate such a fusion protein.

The activity of GPM is about the same as TEF, while the activity of GPD, FBA, FBAIN, FBAINm, GPDIN, GPAT, YAT1 and EXP1 are all greater than TEF (activity is quantified in a relative manner in the column titled "Activity Rank", wherein a '1' corresponds to the promoter with lowest activity, while a '7' corresponds to the promoter with highest activity). This quantitation is based on comparative studies that contains less than about 0.1% ammonium sulfate, or other suitable ammonium salts. In a more preferred embodiment, the YAT1 promoter is induced when the host cell is grown in media with a high carbon to nitrogen (i.e., C:N) ratio, such as a high glucose medium (HGM) containing about 8-12% glucose, and about 0.1% or less ammonium sulfate. These conditions are also sufficient to induce oleaginy in those yeast that are oleaginous (e.g., *Yarrowia lipolytica*). Based on GUS activity of cell extracts, the activity of the YAT1 promoter increased by ~37 fold when cells were switched from a minimal medium into HGM and grown for 24 hrs; after 120 hrs in HGM, the activity was reduced somewhat but was still 25× higher than the activity in minimal medium comprising nitrogen (Example 1).

Of course, in alternate embodiments of the present invention, other promoters which are derived from any of the promoter regions described above in Table 9 also can be used for heterologous expression in *Yarrowia lipolytica* to facilitate the production and accumulation of EPA in the TAG fraction. In particular, modification of the lengths of any of the promoters described above can result in a mutant promoter having identical activity, since the exact boundaries of these regulatory sequences have not been completely defined. In alternate embodiments, the enhancers located within the introns of the FBAIN and GPDIN promoters can be used to create a chimeric promoter having increased activity relative to the native *Yarrowia* promoter (e.g., chimeric GPM::FBAIN and GPM::GPDIN promoters (SEQ ID NOs:182 and 183) had increased activity relative to the GPM promoter alone, when driving expression of the GUS reporter gene in conjunction with a ~100 bp of the 3' region of the *Yarrowia* Xpr gene).

The termination region can be derived from the 3' region of the gene from which the initiation region was obtained or from a different gene. A large number of termination regions are known and function satisfactorily in a variety of hosts (when utilized both in the same and different genera and species from where they were derived). The termination region usually is selected more as a matter of convenience rather than because of any particular property. Preferably, the termination region is derived from a yeast gene, particularly *Saccharomyces, Schizosaccharomyces, Candida, Yarrowia* or *Kluyveromyces*. The 3'-regions of mammalian genes encoding γ-interferon and α-2 interferon are also known to function in yeast. Termination control regions may also be derived from various genes native to the preferred hosts. Optionally, a termination site may be unnecessary; however, it is most preferred if included. Although not intended to be limiting, termination regions useful in the disclosure herein include: ~100 bp of the 3' region of the *Yarrowia lipolytica* extracellular protease (XPR; GenBank Accession No. M17741); the acyl-coA oxidase (Aco3: GenBank Accession No. AJ001301 and No. CAA04661; Pox3: GenBank Accession No. XP_503244) terminators; the Pex20 (GenBank Accession No. AF054613) terminator; the Pex16 (GenBank Accession No. U75433) terminator; the Lip1 (GenBank Accession No. Z50020) terminator; the Lip2 (GenBank Accession No. AJ012632) terminator; and the 3-oxoacyl-coA thiolase (OCT; GenBank Accession No. X69988) terminator.

Additional copies (i.e., more than one copy) of the desaturase, elongase and/or acyltransferase genes described above may be introduced into *Yarrowia lipolytica* to thereby increase EPA production and accumulation. Specifically, additional copies of genes may be cloned within a single expression construct; and/or, additional copies of the cloned gene(s) may be introduced into the host cell by increasing the plasmid copy number or by multiple integration of the cloned gene into the genome (infra). For example, in one embodiment, a strain of *Yarrowia lipolytica* (i.e., strain Y2096) was engineered to produce greater than 25% EPA by the introduction and integration into the *Yarrowia* genome of chimeric genes comprising: 3 copies of a Δ12 desaturase, 2 copies of a Δ6 desaturase, 3 copies of the $C_{18/20}$ elongase EL1S, 1 copy of the $C_{18/20}$ elongase EL2S, 5 copies of a Δ5 desaturase, 3 copies of a Δ17 desaturase and 2 copies of a $C_{16/18}$ elongase. Similarly, in an alternate embodiment, strain Y2201 of *Y. lipolytica* was engineered to produce greater than 9% EPA by the introduction and integration into the *Yarrowia* genome of chimeric genes comprising: 1 copy of a Δ12 desaturase, 1 copy of a $C_{16/18}$ elongase, 5 copies of a Δ9 elongase, 3 copies of a Δ8 desaturase, 4 copies of a Δ5 desaturase and 2 copies of a Δ17 desaturase. Furthermore, in another alternate embodiment, strain L116 of *Y. lipolytica* was engineered to produce about 1.3% EPA by the introduction and integration into the *Yarrowia* genome of chimeric genes comprising: 5 copies of a Δ15 desaturase, 1 copy of a Δ12 desaturase, 2 copies of a Δ9 elongase, 2 copies of a Δ8 desaturase and 1 copy of a bifunctional Δ5/Δ6 desaturase.

In general, once the DNA that is suitable for expression in an oleaginous yeast has been obtained (e.g., a chimeric gene comprising a promoter, ORF and terminator), it is placed in a plasmid vector capable of autonomous replication in a host cell; or, it is directly integrated into the genome of the host cell. Integration of expression cassettes can occur randomly within the host genome or can be targeted through the use of constructs containing regions of homology with the host genome sufficient to target recombination with the host locus. Although not relied on in the present invention, all or some of the transcriptional and translational regulatory regions can be provided by the endogenous locus where constructs are targeted to an endogenous locus.

In the present invention, the preferred method of expressing genes in *Yarrowia lipolytica* is by integration of linear DNA into the genome of the host; and, integration into multiple locations within the genome can be particularly useful when high level expression of genes are desired. Toward this end, it is desirable to identify a sequence within the genome that is present in multiple copies.

Schmid-Berger et al. (*J. Bact.* 176(9):2477-2482 (1994)) discovered the first retrotransposon-like element Ylt1 in *Yarrowia lipolytica*. This retrotransposon is characterized by the presence of long terminal repeats (LTRs; each approximately 700 bp in length) called zeta regions. Ylt1 and solo zeta elements were present in a dispersed manner within the genome in at least 35 copies/genome and 50-60 copies/genome, respectively; both elements were determined to function as sites of homologous recombination. Further, work by Juretzek et al. (*Yeast* 18:97-113 (2001)) demonstrated that gene expression could be dramatically increased by targeting plasmids into the repetitive regions of the yeast genome (using linear DNA with LTR zeta regions at both ends), as compared to the expression obtained using low-copy plasmid transformants. Thus, zeta-directed integration can be ideal as a means to ensure multiple integration of plasmid DNA into *Y. lipolytica*, thereby permitting high-level gene expression. Unfortunately, however, not all strains of *Y. lipolytica* possess zeta regions (e.g., the strain identified as ATCC #20362). When the strain lacks such regions, it is also possible to integrate plasmid DNA comprising expression cassettes into alternate loci to reach the desired copy number for the expression cassette. For example, preferred alternate loci include: the Ura3 locus (GenBank Accession No. AJ306421), the Leu2 gene locus (GenBank Accession No. AF260230), the Lys5 gene (GenBank Accession No. M34929), the Aco2 gene locus (GenBank Accession No. AJ001300), the Pox3 gene locus (Pox3: GenBank Accession No. XP_503244; or, Aco3: GenBank Accession No. AJ001301), the Δ12 desaturase gene locus (SEQ ID NO:23), the Lip1 gene locus (GenBank Accession No. Z50020) and/or the Lip2 gene locus (GenBank Accession No. AJ012632).

Advantageously, the Ura3 gene can be used repeatedly in combination with 5-FOA selection (supra). More specifically, one can first knockout the native Ura3 gene to produce a strain having a Ura-phenotype, wherein selection occurs based on 5-FOA resistance. Then, a cluster of multiple chimeric genes and a new Ura3 gene could be integrated into a different locus of the *Yarrowia* genome to thereby produce a new strain having a Ura+ phenotype. Subsequent integration would produce a new Ura3− strain (again identified using 5-FOA selection), when the introduced Ura3 gene is knocked out. Thus, the Ura3 gene (in combination with 5-FOA selection) can be used as a selection marker in multiple rounds of transformation and thereby readily permit genetic modifications to be integrated into the *Yarrowia* genome in a facile manner.

For some applications, it will be useful to direct the instant proteins to different cellular compartments (e.g., the acyl-CoA pool versus the phosphatidylcholine pool). For the purposes described herein, EPA may be found as free fatty acids or in esterified forms such as acylglycerols, phospholipids, sulfolipids or glycolipids. It is envisioned that the chimeric genes described above encoding polypeptides that permit EPA biosynthesis may be further engineered to include appropriate intracellular targeting sequences.

Juretzek et al. (*Yeast*, 18:97-113 (2001)) note that the stability of integrated plasmid copy number in *Yarrowia lipolytica* is dependent on the individual transformants, the recipient strain and the targeting platform used. Thus, the skilled artisan will recognize that multiple transformants must be screened in order to obtain a strain displaying the desired expression level and pattern. Such screening may be accomplished by Southern analysis of DNA blots (Southern, *J. Mol. Biol.* 98:503 (1975)), Northern analysis of mRNA expression (Kroczek, J. *Chromatogr. Biomed. Appl.*, 618 (1-2):133-145 (1993)), Western analysis of protein expression, phenotypic analysis or GC analysis of the PUFA products.

In summary, each of the means described above is useful to increase the expression of a particular gene product (e.g., a desaturase, elongase, acyltransferase) in *Yarrowia lipolytica*; and, one skilled in the art of biotechnology will readily be capable of selecting the most appropriate combinations of methods to enable high production of EPA.

Pathway Engineering for Increased EPA Production

Although the methodology described above is useful to up-regulate the expression of individual heterologous genes, the challenge of increasing EPA production in *Yarrowia lipolytica* is much more complex and may require coordinated manipulation of various metabolic pathways. Manipulations in the PUFA biosynthetic pathway will be addressed first, followed by desirable manipulations in the TAG biosynthetic pathway and the TAG degradation pathway.

As previously described, the construction of a *Yarrowia lipolytica* strain producing greater than 5% EPA in the total oil fraction, or more preferably greater than 10% EPA in the total oil fraction, or even more preferably greater than 15-20% EPA in the total oil fraction, or most preferably greater than 25-30% EPA in the total oil fraction requires at least the following genes for expression of the Δ6 desaturase/Δ6 elongase pathway: a Δ6 desaturase, a $C_{18/20}$ elongase, a Δ5 desaturase and either a Δ17 desaturase or a Δ15 desaturase (or both); or, at least the following genes for expression of the Δ9 elongase/Δ8 desaturase pathway: a Δ9 elongase, a Δ8 desaturase, a Δ5 desaturase and either a Δ17 desaturase or a Δ15 desaturase (or both). In either embodiment, however, it may be desirable to additionally include a Δ9 desaturase, a Δ12 desaturase, a $C_{14/16}$ elongase and/or a $C_{16/18}$ elongase in the host strain.

In some cases, it may prove advantageous to replace the native *Yarrowia lipolytica* Δ12 desaturase with the *Fusarium moniliforme* Δ12 desaturase, since the latter shows increased percent substrate conversion (WO 2005/047485). More specifically, although both Δ12 desaturases catalyze the conversion of oleic acid to LA, the two enzymes differ in their overall specificity (which thereby affects each enzyme's percent substrate conversion). The Applicants have determined that the *F. moniliforme* Δ12 desaturase has a higher loading capacity of LA onto the sn-2 position of a phosphotidylcholine substrate (thereby facilitating the subsequent reaction by Δ6 desaturase) than the *Y. lipolytica* Δ12 desaturase. On this basis, overexpression of the *F. moniliforme* Δ12 desaturase in conjunction with a knockout of the *Y. lipolytica* Δ12 desaturase may result in increased product for subsequent conversion to EPA.

In some embodiments, it may be useful to regulate the activity of a host organism's native DAG ATs to thereby enable manipulation of the percent of PUFAs within the lipids and oils of the *Y. lipolytica* host. Specifically, since oil biosynthesis is expected to compete with polyunsaturation during oleaginy, it is possible to reduce or inactivate the activity of an organism's one or more acyltransferases (e.g., PDAT and/or DGAT1 and/or DGAT2), to thereby reduce the overall rate of oil biosynthesis while concomitantly increasing the percent of PUFAs (relative to the total fatty acids) that are incorporated into the lipid and oil fractions. This results since polyunsaturation is permitted to occur more efficiently; or, in other words, by down-regulating the activity of specific DAG ATs, the substrate competition between oil biosynthesis and polyunsaturation is reduced in favor of polyunsaturation during oleaginy.

One skilled in the art will have the skills necessary to elucidate the optimum level of down-regulation and the means required to achieve such inhibition. For example, in some preferred embodiments, it may be desirable to manipulate the activity of a single DAG AT (e.g., create a DGAT1 knockout, while the activity of PDAT and DGAT2 are not altered). In alternate embodiments, the oleaginous organism comprises at total of "n" native DAG ATs and the activity of a total of "n-1" acyltransferases are modified to result in a reduced rate of oil biosynthesis, while the remaining acyltransferase retains its wildtype activity. In some situations, it may be desirable to manipulate the activity of all of the native DAG ATs in some preferred oleaginous organisms, to achieve the optimum rate of oil biosynthesis with respect to the rate of polyunsaturation.

In a similar manner, the Applicants hypothesize that expression of heterologous acyltransferases in conjunction with knockouts of the corresponding native *Yarrowia lipolytica* acyltransferase can significantly increase the overall EPA that is produced in the host cells. Specifically, as suggested previously, heterologous GPAT, LPMT, DGAT1, DGAT2, PDAT and LPCAT acyltransferases that have specificity for those fatty acids that are C20 and greater could be preferred over the native enzymes, since naturally produced PUFAs in *Y. lipolytica* are limited to 18:2 fatty acids and the native enzymes may not efficiently catalyze reactions with longer-chain fatty acids. Based on this conclusion, the Applicants identified the genes encoding GPAT, LPAAT, DGAT1 and DGAT2 in *M. alpina* and expressed these genes in engineered *Yarrowia* hosts producing EPA, resulting in increased PUFA biosynthesis (Examples 20-23 herein). Subsequently, the activity of several of the native acyltransferases (e.g., DGAT1 and DGAT2) in *Y. lipolytica* were diminished or knocked-out, as a means to reduce substrate competition between the native and heterologous acyltransferase.

One must also consider manipulation of pathways and global regulators that affect EPA production. For example, it is useful to increase the flow of carbon into the PUFA biosynthetic pathway by increasing the availability of the precursors of longer chain saturated and unsaturated fatty acids, such as palmitate (16:0) and stearic acid (18:0). The synthesis of the former is dependent on the activity of a $C_{14/16}$ elongase, while the synthesis of the latter is dependent on the activity of a $C_{16/18}$ elongase. Thus, over-expression of the native *Yarrowia lipolytica* $C_{14/16}$ elongase (SEQ ID NOs:77 and 78) substantially increased the production of 16:0 and 16:1 fatty acids (22% increase relative to control strains); similarly, over-expression of the native *Y. lipolytica* $C_{16/18}$ elongase (SEQ ID NOs:74 and 75) substantially increased the production of 18:0, 18:1, 18:2 and 18:3 fatty acids (18% increase relative to control strains) and reduced the accumulation of $C_{16}$ fatty acids (22% decrease relative to control strains). Of course, as demonstrated herein and as suggested by the work of Inagaki, K. et al. (*Biosci. Biotech. Biochem.* 66(3):613-621 (2002)), in some embodiments of the present invention it may be useful to co-express a heterologous $C_{16/18}$ elongase (e.g., from *Rattus norvegicus* [GenBank Accession No. AB071986; SEQ ID NOs:63 and 64 herein] and/or from *M. alpina* [SEQ ID NO:66 and 67]. Thus, although a *Y. lipolytica* host strain must minimally be manipulated to express either: (1) a Δ6 desaturase, a $C_{18/20}$ elongase, a Δ5 desaturase and either a Δ17 desaturase or a Δ15 desaturase (or both); or, (2) a Δ9 elongase, a Δ8 desaturase, a Δ5 desaturase and either a Δ17 desaturase or a Δ15 desaturase (or both) for EPA biosynthesis, in further preferred embodiments the host strain additionally includes at least one of the following: a Δ9 desaturase, a Δ12 desaturase, a $C_{14/16}$ elongase and/or a $C_{16/18}$ elongase.

In another preferred embodiment, those pathways that affect fatty acid degradation and TAG degradation were modified in the *Yarrowia lipolytica* of the present invention, to minimize the degradation of EPA that had accumulated in the cells in either the acyl-CoA pool or in the TAG fraction. These pathways are represented by the acyl-CoA oxidase and lipase genes, respectively. More specifically, the acyl-CoA oxidases (EC 1.3.3.6) catalyze a peroxisomal β-oxidation reaction wherein each cycle of degradation yields an acetyl-CoA molecule and a fatty acid that is two carbon atoms shorter than the fatty acid substrate. Five acyl-CoA oxidase isozymes are present in *Yarrowia lipolytica*, encoded by the POX1, POX2, POX3, POX4 and POX5 genes (also known as the Aco1, Aco2, Aco3, Aco4 and Aco5 genes), corresponding to GenBank Accession Nos. AJ001299-AJ001303, respectively (see also corresponding GenBank Accession Nos. XP_504703, XP_505264, XP_503244, XP_504475 and XP_502199). Each of the isozymes has a different substrate specificity; for example, the POX3 gene encodes an acyl-CoA oxidase that is active against short-chain fatty acids, whereas the POX2 gene encodes an acyl-CoA oxidase that is active against longer-chain fatty acids (Wang H. J., et al. *J. Bacteriol.*, 181:5140-5148 (1999)). It is contemplated that the activity of any one of these genes could be reduced or eliminated, to thereby modify peroxisomal β-oxidation in the host cell of the invention in a manner that could be advantageous to the purposes herein. Finally, to avoid any confusion, the Applicants will refer to the acyl-CoA oxidases as described above as POX genes, although this terminology can be used interchangeably with the Aco gene nomeclature, according to some publicly available literature.

Similarly, several lipases (EC 3.1.1.3) have been detected in *Y. lipolytica*, including intracellular, membrane-bound and extracellular enzymes (Choupina, A., et al. *Curr. Genet.* 35:297 (1999); Pignede, G., et al. *J. Bacteriol.* 182:2802-2810 (2000)). For example, Lip1 (GenBank Accession No. Z50020) and Lip3 (GenBank Accession No. AJ249751) are intracellular or membrane bound, while Lip2 (GenBank Accession No. AJ012632) encodes an extracellular lipase. Each of these lipases were targets for disruption, since the enzymes catalyze the reaction wherein TAG and water are degraded directly to DAG and a fatty acid anion.

In a further alternate embodiment, the activity of several phospholipases can be manipulated in the preferred host strain of *Yarrowia lipolytica*. Phospholipases play a critical role in the biosynthesis and degradation of membrane lipids. More specifically, the term "phospholipase" refers to a heterogeneous group of enzymes that share the ability to hydrolyze one or more ester linkage in glycerophospholipids. Although all phospholipases target phospholipids as substrates, each enzyme has the ability to cleave a specific ester bond. Thus, phospholipase nomeclature differentitates individual phospholipases and indicates the specific bond targeted in the phospholipid molecule. For example, phospholipase $A_1$ ($PLA_1$) hydrolyzes the fatty acyl ester bond at the sn-1 position of the glycerol moiety, while phospholipase $A_2$ ($PLA_2$) removes the fatty acid at the sn-2 position of this molecule. The action of $PLA_1$ (EC 3.1.1.32) and $PLA_2$ (EC 3.1.1.4) results in the accumulation of free fatty acids and 2-acyl lysophospholipid or 1-acyl lysophospholipid, respectively. Phospholipase C (PLC) (EC 3.1.4.3) hydrolyzes the phosphodiester bond in the phospholipid backbone to yield 1,2-DAG and, depending on the specific phospholipid species involved, phosphatidylcholine, phosphatidylethanolamine, etc. (e.g., $PLC_1$ is responsible for the reaction: 1-phosphatidyl-1 D-myo-inositol 4,5-bisphosphate+$H_2O$=1 D-myo-inositol 1,4,5-trisphosphate+DAG; ISC1 encodes an inositol phosphosphingolipid-specific phospholipase C [Sawai, H., et al. *J. Biol. Chem.* 275, 39793-39798 (2000)]). The second phosphodiester bond is cleaved by phospholipase D (PLD) (EC 3.1.4.4) to yield phosphatidic acid and choline or ethanolamine, again depending on the phospholipid class involved. Phospholipase B (PLB) has the capability of removing both sn-1 and sn-2 fatty acids and is unique in having both hydrolase (wherein the enzyme cleaves fatty acids from both phospholipids [PLB activity] and lysophospholipids [lysophospholipase activity] for fatty acid release) and lysophospholipase-transacylase activities (wherein the enzyme can produce phospholipid by transferring a free fatty acid to a lysophospholipid). As demonstrated in the invention herein, it may be useful to overexpress one or more of these phopsholipases, in order to increase the concentration of EPA that accumulates in the total oil fraction of the transformant *Yarrowia* host cells. It is hypothesized that this affect is observed because the phospholipases release acyl groups from PC into the CoA pool either for elongation or incorporation into triglycerides.

In another alternate embodiment, those enzymes in the CDP-choline pathway responsible for phosphatidylcholine (PC) biosynthesis can also be manipulated in the preferred host strain of *Yarrowia lipolytica*, as a means to increase overall EPA biosynthesis. The utility of this technique was demonstrated in the invention herein by the overexpression of the *Y. lipolytica* CPT1 gene encoding diacylglycerol cholinephosphotransferase (EC 2.7.8.2), thereby resulting in increased EPA biosynthesis in an engineered strain of *Y. lipolytica*. One skilled in the art will be familiar with the PC biosynthetic pathway and recognize other appropriate candidate enzymes.

Although methods for manipulating biochemical pathways such as those described above are well known to those skilled in the art, an overview of some techniques for reducing or eliminating the activity of a native gene will be briefly presented below. These techniques would be useful to down-regulate the activity of the native *Yarrowia lipolytica* Δ12 desaturase, GPAT, LPAAT, DGAT1, DGAT2, PDAT, LPCAT, acyl-CoA oxidase 2 (Aco2 or Pox2), acyl-CoA oxidase 3 (Aco3 or Pox3) and/or lipase genes, as discussed above.

Although one skilled in the art will be well equipped to ascertain the most appropriate technique to be utilized to reduce or eliminate the activity of a native gene, in general, the endogenous activity of a particular gene can be reduced or eliminated by, for example: 1.) disrupting the gene through insertion, substitution and/or deletion of all or part of the target gene; 2.) providing a cassette for transcription of anti-sense sequences to the gene's transcription product; 3.) using a host cell which naturally has [or has been mutated to have] little or none of the specific gene's activity; 4.) over-expressing a mutagenized hereosubunit (i.e., in an enzyme that comprises two or more hereosubunits), to thereby reduce the enzyme's activity as a result of the "dominant negative effect"; and 5.) using iRNA technology. In some cases, inhibition of undesired gene pathways can also be accomplished through the use of specific inhibitors (e.g., desaturase inhibitors such as those described in U.S. Pat. No. 4,778,630).

For gene disruption, a foreign DNA fragment (typically a selectable marker gene, but optionally a chimeric gene or chimeric gene cluster conveying a desirable phenotype upon expression) is inserted into the structural gene to be disrupted in order to interrupt its coding sequence and thereby functionally inactivate the gene. Transformation of the disruption cassette into the host cell results in replacement of the functional native gene by homologous recombination with the non-functional disrupted gene (see, for example: Hamilton et al. *J. Bacteriol.* 171:4617-4622 (1989); Balbas et al. *Gene* 136:211-213 (1993); Gueldener et al. *Nucleic Acids Res.* 24:2519-2524 (1996); and Smith et al. *Methods Mol. Cell. Biol.* 5:270-277(1996)).

Antisense technology is another method of down-regulating genes when the sequence of the target gene is known. To accomplish this, a nucleic acid segment from the desired gene is cloned and operably linked to a promoter such that the anti-sense strand of RNA will be transcribed. This construct is then introduced into the host cell and the antisense strand of RNA is produced. Antisense RNA inhibits gene expression by preventing the accumulation of mRNA that encodes the protein of interest. The person skilled in the art will know that special considerations are associated with the use of antisense technologies in order to reduce expression of particular genes. For example, the proper level of expression of anti-sense genes may require the use of different chimeric genes utilizing different regulatory elements known to the skilled artisan.

Although targeted gene disruption and antisense technology offer effective means of down-regulating genes where the sequence is known, other less specific methodologies have been developed that are not sequence-based (e.g., mutagenesis via UV radiation/chemical agents or use of transposable elements/transposons; see WO 04/101757).

In alternate embodiments, the endogenous activity of a particular gene can be reduced by manipulating the regulatory sequences controlling the expression of the protein. As is well known in the art, the regulatory sequences associated with a coding sequence include transcriptional and translational "control" nucleotide sequences located upstream (5' non-coding sequences), within, or downstream (3' non-coding sequences) of the coding sequence, and which influence the transcription, RNA processing or stability, or translation of the associated coding sequence. Thus, manipulation of a particular gene's regulatory sequences may refer to manipulation of the gene's promoters, translation leader sequences, introns, enhancers, initiation control regions, polyadenylation recognition sequences, RNA processing sites, effector binding sites and stem-loop structures. Thus, for example, the promoter of a DAG AT could be deleted or disrupted, in order to down-regulate the DAG AT's expression and thereby achieve a reduced rate of lipid and oil biosynthesis. Alternatively, the native promoter driving expression of a DAG AT could be substituted with a heterologous promoter having diminished promoter activity with respect to the native promoter. Methods useful for manipulating regulatory sequences are well known to those skilled in the art.

In summary, using the teachings provided herein, transformant oleaginous microbial hosts will produce of at least about 5% EPA in the total lipids of the microbial host, preferably at least about 10% EPA in the total lipids, more preferably at least about 15% EPA in the total lipids, more preferably at least about 20% EPA in the total lipids, more preferably at least about 25-30% EPA in the total lipids, more preferably at least about 30-35% EPA in the total lipids, more preferably at least about 35-40%, and most most preferably at least about 40-50% EPA in the total lipids.

Fermentation Processes for EPA Production

The transformed microbial host cell is grown under conditions that optimize expression of chimeric genes (e.g., encoding desaturases, elongases, acyltransferases, etc.) and produce the greatest and the most economical yield of EPA. In general, media conditions that may be optimized include the type and amount of carbon source, the type and amount of nitrogen source, the carbon-to-nitrogen ratio, the oxygen level, growth temperature, pH, length of the biomass production phase, length of the oil accumulation phase and the time of cell harvest. *Yarrowia lipolytica* are generally grown in complex media (e.g., yeast extract-peptone-dextrose broth (YPD)) or a defined minimal media that lacks a component necessary for growth and thereby forces selection of the desired expression cassettes (e.g., Yeast Nitrogen Base (DIFCO Laboratories, Detroit, Mich.)).

Fermentation media in the present invention must contain a suitable carbon source. Suitable carbon sources may include, but are not limited to: monosaccharides (e.g., glucose, fructose), disaccharides (e.g., lactose, sucrose), oligosaccharides, polysaccharides (e.g., starch, cellulose or mixtures thereof), sugar alcohols (e.g., glycerol) or mixtures from renewable feedstocks (e.g., cheese whey permeate, cornsteep liquor, sugar beet molasses, barley malt). Additionally, carbon sources may include alkanes, fatty acids, esters of fatty acids, monoglycerides, diglycerides, triglycerides, phospholipids and various commercial sources of fatty acids including vegetable oils (e.g., soybean oil) and animal fats. Additionally, the carbon source may include one-carbon sources (e.g., carbon dioxide, methanol, formaldehyde, formate and carbon-containing amines) for which metabolic conversion into key biochemical intermediates has been demonstrated. Hence it is contemplated that the source of carbon utilized in the present invention may encompass a wide variety of carbon-containing sources. Although all of the above mentioned carbon sources and mixtures thereof are expected to be suitable in the present invention, preferred carbon sources are sugars and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the oleaginous yeast and promotion of the enzymatic pathways necessary for EPA production. Particular attention is given to several metal ions (e.g., $Mn^{+2}$, $Co^{+2}$, $Zn^{+2}$, $Mg^{+2}$) that promote synthesis of lipids and PUFAs (Nakahara, T. et al., *Ind. Appl. Single Cell Oils*, D. J. Kyle and R. Colin, eds. pp 61-97 (1992)).

Preferred growth media in the present invention are common commercially prepared media, such as Yeast Nitrogen Base (DIFCO Laboratories, Detroit, Mich.). Other defined or synthetic growth media may also be used and the appropriate medium for growth of *Yarrowia lipolytica* will be known by one skilled in the art of microbiology or fermentation science. A suitable pH range for the fermentation is typically between about pH 4.0 to pH 8.0, wherein pH 5.5 to pH 7.0 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of EPA in *Yarrowia lipolytica*. This approach is described in WO 2004/101757, as are various suitable fermentation process designs (i.e., batch, fed-batch and continuous) and considerations during growth.

Purification and Processing of EPA

PUFAs, including EPA, may be found in the host microorganism as free fatty acids or in esterified forms such as acylglycerols, phospholipids, sulfolipids or glycolipids, and may be extracted from the host cell through a variety of means well-known in the art. One review of extraction techniques, quality analysis and acceptability standards for yeast lipids is that of Z. Jacobs (*Critical Reviews in Biotechnology*, 12(5/6): 463-491 (1992)). A brief review of downstream processing is also available by A. Singh and 0. Ward (*Adv. Appl. Microbiol.*, 45:271-312 (1997)).

In general, means for the purification of EPA and other PUFAs may include extraction with organic solvents, sonication, supercritical fluid extraction (e.g., using carbon dioxide), saponification and physical means such as presses, or combinations thereof. One is referred to the teachings of WO 2004/101757 for additional details.

Oils containing EPA that have been refined and/or purified can be hydrogenated, to thereby result in fats with various melting properties and textures. Many processed fats, including spreads, confectionary fats, hard butters, margarines, baking shortenings, etc., require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction and which, in turn, alter the composition of the final product. Operating conditions including pressure, temperature, catalyst type and concentration, agitation and reactor design are among the more important parameters which can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings, used in the manufacture of baking products, solid fats and shortenings used for commercial frying and roasting operations, and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society, 1994.

EPA-Producing Strains of *Y. Lipolytica* for Use in Foodstuffs

The market place currently supports a large variety of food and feed products, incorporating ω-3 and/or ω-6 fatty acids (particularly ARA, EPA and DHA). It is contemplated that the yeast microbial oils of the invention comprising EPA will function in food and feed products to impart the health benefits of current formulations.

Microbial oils containing ω-3 and/or ω-6 fatty acids produced by the yeast hosts described herein will be suitable for use in a variety of food and feed products including, but not limited to food analogs, meat products, cereal products, baked foods, snack foods, and a dairy products. Additionally the present microbial oils may be used in formulations to impart health benefit in medical foods including medical nutritionals, dietary supplements, infant formula as well as pharmaceutical products. One of skill in the art of food processing and food formulation will understand how the amount and composition of the microbial oil may be added to the food or feed product. Such an amount will be referred to herein as an "effective" amount and will depend on the food or feed product, the diet that the product is intended to supplement or the medical condition that the medical food or medical nutritional is intended to correct or treat.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to: imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food product include, but are not limited to: whole grain, crushed grain, grits, flour, bran, germ, breakfast cereals, extruded foods, pastas, and the like.

A baked goods product comprises any of the cereal food products mentioned above and has been baked or processed in a manner comparable to baking, i.e., to dry or harden by subjecting to heat. Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils of the invention can be used as an ingredient.

A snack food product comprises any of the above or below described food products.

A fried food product comprises any of the above or below described food products that has been fried.

The beverage can be in a liquid or in a dry powdered form. For example, there can be mentioned non-carbonated drinks; fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aquous solution (e.g., see U.S. Pat. No. 4,670,285). Based on the worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ [Mead Johnson & Company] and Similac Advance™ [Ross Products Division, Abbott Laboratories]). Infant formulas have a special role to play in the diets of infants because they are often the only source of nutrients for infants; and, although breast-feeding is still the best nourishment for infants, infant formula is a close enough second that babies not only survive but thrive.

A dairy product is a product derived from milk. A milk analog or nondairy product is derived from a source other than milk, for example, soymilk as was discussed above. These products include, but are not limited to: whole milk, skim milk, fermented milk products such as yogurt or sour milk, cream, butter, condensed milk, dehydrated milk, coffee whitener, coffee creamer, ice cream, cheese, etc.

Additional food products into which the EPA-containing oils of the invention could be included are, for example: chewing gums, confections and frostings, gelatins and puddings, hard and soft candies, jams and jellies, white granulated sugar, sugar substitutes, sweet sauces, toppings and syrups, and dry-blended powder mixes.

Health Food Products, and Pharmaceuticals

A health food product is any food product that imparts a health benefit and include functional foods, medical foods, medical nutritionals and dietary supplements. Additionally, microbial oils of the invention may be used in standard pharmaceutical compositions. The present engineered strains of *Yarrowia lipolytica* or the microbial oils produced therefrom comprising EPA could readily be incorporated into the any of the above mentioned food products, to thereby produce e.g., a functional or medical food. For example more concentrated formulations comprising ARA or EPA include capsules, powders, tablets, softgels, gelcaps, liquid concentrates and emulsions which can be used as a dietary supplement in humans or animals other than humans.

Use in Animal Feeds

Animal feeds are generically defined herein as products intended for use as feed or for mixing in feed for animals other than humans. The EPA-comprising oils of the invention can be used as an ingredient in various animal feeds.

More specifically, although not limited therein, it is expected that the oils of the invention can be used within pet food products, ruminant and poultry food products and aquacultural food products. Pet food products are those products intended to be fed to a pet [e.g., a dog, cat, bird, reptile, rodent]; these products can include the cereal and health food products above, as well as meat and meat byproducts, soy protein products, grass and hay products (e.g., alfalfa, timothy, oat or brome grass, vegetables). Ruminant and poultry food products are those wherein the product is intended to be fed to e.g., turkeys, chickens, cattle and swine. As with the pet foods above, these products can include cereal and health food products, soy protein products, meat and meat byproducts, and grass and hay products as listed above. Aquacultural food products (or "aquafeeds") are those products intended to be used in aquafarming which concerns the propagation, cultivation or farming of aquatic organisms and/or animals in fresh or marine waters.

It is contemplated that the present engineered strains of *Yarrowia lipolytica* that are producing high concentrations of ARA, EPA and/or DHA will be especially useful to include in most animal feed formulations. In addition to providing necessary ω-3 and/or ω-6 PUFAs, the yeast itself is a useful source of protein and other nutrients (e.g., vitamins, minerals, nucleic acids, complex carbohydrates, etc.) that can contribute to overall animal health and nutrition, as well as increase a formulation's palatablility. Accordingly it is contemplated that the addition of yeast biomass comprising the recombinant production hosts of the invention will be an excellent additional source of feed nutrients in animal feed formulations. More specifically, *Yarrowia lipolytica* (ATCC #20362) has the following approximate chemical composition, as a percent relative to the dry cell weight: 35% protein, 40% lipid, 10% carbohydrate, 5% nucleic acids, 5% ash and 5% moisture. Furthermore, within the carbohydrate fraction, α-glucans comprise approximately 45.6 mg/g, mannans comprise approximately 11.4 mg/g, and chitin comprises approximately 52.6 mg/g (while trehalose is a minor component [approximately 0.7 mg/g]).

A considerable body of literature has examined the immuno-modulating effects of β-glucans, mannans and chitin. The means by which β-glucans, the primary constituents of bacterial and fungal cell walls, stimulate non-specific immunity (i.e., "immunostimulant effects") to thereby improve health of aquaculture species, pets and farm animals and humans are best studied, although both chitin and mannans are similarly recognized as useful immunostimulants. Simplistically, an overall enhancement of immune response can be achieved by the use of β-glucans, since these β-1,3-D-polyglucose molecules stimulate the production of white blood cells (e.g., macrophages, neutrophils and monocytes) in a non-specific manner to thereby enable increased sensitivity and defense against a variety of pathogenic antigens or environmental stressors. More specifically, numerous studies have demonstrated that β-glucans: convey enhanced protection against viral, bacterial, fungal and parasitic infections; exert an adjuvant effect when used in conjunction with antibiotics and vaccines; enhance wound healing; counter damage resulting from free radicals; enhance tumor regression; modulate toxicity of bacterial endotoxins; and strengthen mucosal immunity (reviewed in Raa, J. et al., *Norwegian Beta Glucan Research, Clinical Applications of Natural Medicine. Immune: Depressions Dysfunction & Deficiency* (1990)). A sample of current literature documenting the utility of yeast β-glucans, mannans and chitins in both traditional animal husbandry and within the aquacultural sector include: L. A. White et al. (*J. Anim. Sci.* 80:2619-2628 (2002)), supplementation in weanling pigs; K. S. Swanson et al. (*J. Nutr.* 132: 980-989 (2002)), supplementation in dogs; J. Ortuño et al. (*Vet. Immunol. Immonopath.* 85:41-50 (2002)), whole *Saccharomyces cerevisiae* administered to gilthead seabream; A. Rodriguez et al. (*Fish Shell. Immuno.* 16:241-249 (2004)), whole *Mucor circinelloides* administered to gilthead seabream; M. Bagni et al. (*Fish Shell. Immuno.* 18:311-325 (2005)), supplementation of sea bass with a yeast extract containing β-glucans; J. Raa (In: Cruz-Suárez, L. E., Ricque-Marie, D., Tapia-Salazar, M., Olvera-Novoa, M. A. y Civera-Cerecedo, R., (Eds.). Avances en Nutrición Acuícola V. Memorias del V Simposium Internacional de Nutrición Acuícola. 19-22 Noviembre, 2000. Mérida, Yucatán, Mexico), a review of the use of immune-stimulants in fish and shellfish feeds.

Based on the unique protein:lipid:carbohydrate composition of *Yarrowia lipolytica*, as well as unique complex carbohydrate profile (comprising an approximate 1:4:4.6 ratio of mannan:β-glucans:chitin), it is contempated that the genetically engineered yeast cells of the present invention (or portions thereof) would be a useful additive to animal feed formulations (e.g., as whole [lyophilized] yeast cells, as purified cells walls, as purified yeast carbohydrates or within various other fractionated forms).

With respect to the aquaculture industry, an Increased understanding of the nutritional requirements for various fish species and technological advances in feed manufacturing have allowed the development and use of manufactured or artificial diets (formulated feeds) to supplement or to replace natural feeds in the aquaculture industry. In general, however, the general proportions of various nutrients included in aquaculture feeds for fish include (with respect to the percent by dry diet): 32-45% proteins, 4-28% fat (of which at least 1-2% are ω-3 and/or ω-6 PUFAs), 10-30% carbohydrates, 1.0-2.5% minerals and 1.0-2.5% vitamins. A variety of other ingredients may optionally be added to the formulation. These include: (1) carotenoids, particularly for salmonid and ornamental "aquarium" fishes, to enhance flesh and skin coloration, respectively; (2) binding agents, to provide stability to the pellet and reduce leaching of nutrients into the water (e.g., beef heart, starch, cellulose, pectin, gelatin, gum arabic, locust bean, agar, carageenin and other alginates); (3) preservatives, such as antimicrobials and antioxidants, to extend the shelf-life of fish diets and reduce the rancidity of the fats (e.g., vitamin E, butylated hydroxyanisole, butylated hydroxytoluene, ethoxyquin, and sodium and potassium salts of propionic, benzoic or sorbic acids); (4) chemoattractants and flavorings, to enhance feed palatability and its intake; and, (5) other feedstuffs. These other feedstuffs can include such materials as fiber and ash (for use as a filler and as a source of calcium and phosphorus, respectively) and vegetable matter and/or fish or squid meal (e.g., live, frozen or dried algae, brine shrimp, rotifers or other zooplankton) to enhance the nutritional value of the diet and increase its acceptance by the fish. *Nutrient Requirements of Fish* (National Research Council, National Academy: Washington D.C., 1993) provides detailed descriptions of the essential nutrients for fish and the nutrient content of various ingredients.

The manufacture of aquafeed formulations requires consideration of a variety of factors, since a complete diet must be nutritionally balanced, palatable, water stable, and have the proper size and texture. With regard to nutrient composition of aquafeeds, one is referred to: *Handbook on Ingredients for Aquaculture Feeds* (Hertrampf, J. W. and F. Piedad-Pascual. Kluwer Academic: Dordrecht, The Netherlands, 2000) and *Standard Methods for the Nutrition and Feeding of Farmed Fish and Shrimp* (Tacon, A. G. J. Argent Laboratories: Redmond, 1990). In general, feeds are formulated to be dry (i.e., final moisture content of 6-10%), semi-moist (i.e., 35-40% water content) or wet (i.e., 50-70% water content). Dry feeds include the following: simple loose mixtures of dry ingredients (i.e., "mash" or "meals"); compressed pellets, crumbles or granules; and flakes. Depending on the feeding requirements of the fish, pellets can be made to sink or float. Semi-moist and wet feeds are made from single or mixed ingredients (e.g., trash fish or cooked legumes) and can be shaped into cakes or balls.

It is clear then that the present engineered strains of *Yarrowia lipolytica* that are producing high concentrations of EPA will be especially useful to include in most aquaculture feeds. In addition to providing necessary ω-3 and/or ω-6 PUFAs, the yeast itself is a useful source of protein that can increase the formulation's palatablility. In alternate embodiments, the oils produced by the present strains of *Y. lipolytica* could be introduced directly into the aquaculture feed formulations, following extraction and purification from the cell mass.

Clinical Health Benefits Resulting from EPA Oil Supplementation

Although dietary supplementation of EPA has been shown to be useful to lower serum cholesterol and triglycerides and have salutary effects in e.g., coronary heart disease, high blood pressure, inflammatory disorders (e.g., rheumatoid arthritis), lung and kidney diseases, Type II diabetes, obesity, ulcerative colitis, Crohn's disease, anorexia nervosa, burns, osteoarthritis, osteoporosis, attention deficit/hyperactivity disorder, early stages of colorectal cancer and mental disorders (e.g., schizophrenia) (see, for example, the review of McColl, J., *NutraCos* 2(4):35-40 (2003); Sinclair, A., et al. In *Healthful Lipids*; C. C. Akoh and O.-M. Lai, Eds; AOCS: Champaign, Ill. (2005), Chapter 16), the molecular and biochemical mechanisms underlying these clinical observations remain to be elucidated. Notably, many past studies have failed to recognize that individual long-chain ω-3 fatty acids (e.g., EPA and DHA) are metabolically and functionally distinct from one another, and thus each may have a specific physiological function. This lack of mechanistic clarity is largely a consequence of the use of fish oils as a source of the PUFAs, as opposed to use of pure EPA or pure DHA in clinical studies [the fatty acid composition of oils from menhaden, cod liver, sardines and anchovies, for example, comprise oils having a ratio of EPA:DHA of approximately 0.9:1 to 1.6:1 (based on data within *The Lipid Handbook*, $2^{nd}$ ed.; F. D. Gunstone, J. L. Harwood and F. B. Padley, Eds; Chapman and Hall, 1994)]. Nonetheless, there is increasing awareness that EPA is an important ω-3 fatty acid in and of itself. As a result, it is expected herein that the EPA-enriched oils of the invention will have very broad utility in a variety of therapeutic applications e.g., inflammation, cardiovascular diseases, nutrient regulation of gene expression and dyslipidemia, and specifically in the treatment of clinical conditions including, coronary heart disease, high blood pressure, inflammatory disorders, Type II diabetes, ulcerative colitis, Crohn's disease, anorexia nervosa, burns, osteoarthritis, osteoporosis, and attention deficit/hyperactivity disorder.

Although the results described below in relation to each of these applications are based on clinical human studies, this should not be construed as limiting to the invention herein; specifically, the Applicants foresee use of EPA-enriched oils for treatment of similar health concerns in a variety of other animals (e.g., household pets, ruminant animals, poultry, fish, etc.).

EPA And Inflammation: Many biochemical mechanisms have been proposed to explain the anti-inflammatory properties conveyed by fish oils. Currently, a popular mechanism suggests that ω-3 fatty acids decrease the amount of ω-6 fatty acids in inflammatory cell membranes and inhibit ω-6 fatty acid metabolism that enables synthesis of pro-inflammatory mediators derived from ω-6 fatty acids (e.g., series 2 prostaglandins and series 4 leukotrienes). Additionally, the ω-3 fatty acids give rise to potent inflammatory mediators (e.g., series 3 prostaglandins and series 5 leukotrienes). However, recent studies have now identified a new family of lipid anti-inflammatory mediators, termed resolvins ("resolution phase interaction products"), which are very potent as indicated by their biological activity in the low nanomolar range. Within this family are both EPA-derived resolvins (i.e., E-series resolvins or "RvEs") and DHA-derived resolvins (i.e., D-series resolvins or "RvDs") (reviewed in Serhan, C. N., *Pharma. & Therapeutics,* 105:7-21 (2005)). The distinct role of RvE1 (5S, 12R,18R-trihydroxy-6Z,8E,10E,14Z, 16E-EPA), as demonstrated in Arita, M. et al. (*PNAS,* 102(21):7671-7676 (2005)) offers mechanistic evidence that may form the basis for some of the beneficial actions of EPA in human health and disease.

This new biology underscores the potential utility of EPA-rich products in both the nutritional and medical management of inflammatory processes. Furthermore, since inflammation underlies many diseases ranging from cardiovascular to metabolic (e.g., metabolic syndrome X, obesity, diabetes) to neurological diseases (e.g., Alzheimers), it is expected that EPA-enriched oils (such as those of the present invention) will have very broad utility. It is expected that medical utility may be derived from: (1) use of EPA or RvEs as bioactives in medical foods; and/or (2) addition of EPA to over-the-counter or prescriptive medications as adjunctive therapy. Finally, EPA may find utility as a precursor for the synthesis of RvEs and medicinally-optimized new chemical entities.

EPA And Cardiovascular Diseases: Fish oil and its related ω-3 fatty acids have shown considerable cardioprotection in the management of cardiovascular disease in secondary prevention (i.e., a setting wherein subjects already presented with cardiovascular symptoms or who had suffered a cardiovascular event). As promising as these studies are, however, they leave a number of key questions unanswered; notably, the relative importance of EPA versus DHA and the efficacy of these fatty acids in a primary prevention setting [e.g., in patients with: (1) no history of myocardial infarction or angina pectoris and with neither angioplasty/stenting nor coronary artery bypass grafts; and (2) no clinical manifestations of angina pectoris or electrocardiograph abnormalities]. The Japanese EPA Lipid Intervention Study ("JELIS") endeavors to address these questions in a large-scale randomized controlled trial using >98% purified EPA-ethyl esters in combination with a statin (Yokoyama, M. and H. Origasa, *Amer. Heart J.,* 146:613-620 (2003)). Although final analysis of results is not expected until late 2005, the authors predict that cardiovascular events in patients receiving EPA plus statin would be decreased by ~25% with respect to those patients receiving statin alone. Furthermore, should this study yield the results expected, this will provide strong support that EPA, per se, is cardioprotective, and thereby open the market for EPA-enriched oils. It may also afford opportunities to combine EPA/resolvin type mixtures with statins, and/or for the yeast oils of the invention to be utilized as a high purity source of EPA in the production of EPA-ethyl ester drugs that are presently sourced and manufactured from fish oil (e.g., EPADEL from Mochida Pharmaceutical Co., Ltd., Tokyo, Japan).

Omega-3 PUFAs And Nutrient Regulation Of Gene Expression: It is well known that long-chain ω-3 PUFAs function as fuel partitioners capable of directing: (1) glucose away from fatty acid biosynthesis and toward glycogen storage; and, (2) fatty acids away from triglyceride synthesis and toward oxidation. The net effect of this re-partitioning is a decrease in circulating triglycerides and, in some species, a decrease in fat deposition. There is increasing scientific evidence that the molecular mechanisms by which these long-chain ω-3 PUFAs exert their effects on metabolism is the result of interactions with various ligand-activated transcription factors which in turn regulate gene expression.

To date, the regulation of gene transcription by fatty acids seems to be due to changes in the activity or abundance of at least 4 transcription factor families: PPAR (peroxisome proliferator-activated receptor), LXR (liver x receptor), HNF-4α (hepatic Nuclear factor4) and SREBP (sterol regulatory element binding protein) (see, Clarke, S. D., *J Nutr.,* 131(4):1129-1132 (2001) and *Curr. Opin. Lipidology,* 15:13-18 (2004); Pégorier, J.-P. et al., *J Nutr.,* 134:2444S-2449S (2004)). As an example of this interaction, it is believed that EPA lowers serum triglycerides via activation of PPARα in the liver; and, some of its anti-inflammatory activity (particularly at the level of the vessel wall) may also be mediated by PPAR biology in arterial macrophages.

Knowledge of the mechanisms by which fatty acids control specific gene expression may provide insight into the development of new therapeutic strategies for better management of whole body lipid metabolism and the control of serum levels of triglycerides and cholesterol (established risk factors for coronary heart diseases and other chronic diseases). Likewise, it is expected that future studies will appreciate the differential roles EPA versus DHA play as regulators of nutrient-gene interactions in the maintaining and promoting of optimal human health.

Omega-3 PUFAs And Dyslipidemia: Intake of fish oil has often been associated with a slight increase in low-density lipoprotein (LDL) cholesterol, an untoward event that conveys an increased risk of heart disease. The recent study of Theobald, H. E. et al. (*Amer. J. Clinical Nutrition,* 79:558-563 (2004)) suggests that this elevation in LDL cholesterol may actually be due to DHA (as opposed to EPA). Specifically, daily intake of ~0.7 g DHA increased LDL cholesterol by 7% in middle-aged men and women over a 3 month period; in contrast, studies using purified EPA or EPA-rich oil have generally not reported similar increases in LDL cholesterol (Harris, W. S. *Amer. J. Clinical Nutrition,* 65(Supplement): 1645S-1654S (1997)). Although further studies are necessary to clarify the reasons for the increase in LDL cholesterol resulting from low dosages of DHA, the utility of the EPA-rich oils of the present invention that do not contain DHA potentially may have significant clinical advantages.

Although it may be desirable to purify the microbial oils of the present invention to result in an oil that comprises relatively pure EPA, in alternate embodiments there may be advantages observed by use of a final oil product that is enriched in EPA and at least one other PUFA. For example, evidence indicates that supplementation with a combination of EPA and GLA may have a favorable impact on serum lipids. Specifically, as reported by M. Laidlaw and B. J. Holub (*Amer. J. Clinical Nutrition*, 77:37-42 (2003)), a daily supplement comprising a mixture of EPA and DHA (4 g total) and GLA (2 g) favorably altered blood lipid and fatty acid profiles in healthy women over the course of 28 days. In addition to decreasing the LDL cholesterol of patients by 11.3%, the calculated 10-year risk of myocardial infarction was reduced by 43% in those patients receiving EPA, DHA and GLA. Thus, the addition of GLA offset the tendency of EPA and DHA to cause a slight elevation of LDL cholesterol (Theobald et al., supra). Taken together, the studies by Laidlaw & Holub and Theobald et al. may suggest clinical benefit in an oil enriched with both EPA and GLA, but not DHA.

The utility of a GLA and EPA supplement combination has also been widely popularized as a means to reduce and combat chronic inflammation as it relates to diseases such as arthritis, diabetes and heart disease (F. Chilton and L. Tucker, *Inflammation Nation: The First Clinically Proven Eating Plan to End Our Nation's Secret Epidemic*. Fireside Books). Specifically, although GLA supplementation was previously shown to reduce the generation of lipid mediators of inflammation and attenuate clinical symptoms of chronic inflammatory disorders (e.g., rheumatoid arthritis), supplementation with this same fatty acid also was known to cause a marked increase in serum ARA levels, a potentially harmful side effect. The rationale for these dichotomous effects was credited to the presence of Δ5 desaturase activity in the liver, which enabled complete conversion of the essential ω-6 fatty acid LA to ARA (via the ω-6 Δ6 desaturase/Δ6 elongase pathway and through GLA and DGLA intermediates), while inflammatory cells such as neutrophils lacked the metabolic capacity to convert DGLA to ARA. It was therefore hypothesized that co-supplementation with EPA would block the synthesis of ARA in the liver, while enabling synthesis of DGLA. Clinical proof of principle was established in human feeding studies by J. B. Barham et al. (*J. Nutr.* 130:1925-1931 (2000)), wherein a supplementation strategy that maintained the capacity of GLA to reduce lipid mediators (without causing elevations in serum ARA level) was demonstrated to require addition of EPA. Thus, these studies relating to inflammation provide further support for the utility of oils comprising GLA and EPA (while the use of GLA in the absence of EPA supplementation may be contraindicated).

In the present invention, Applicants describe several EPA-producing *Y. lipolytica* strains that also produce significant proportions of GLA in the total lipids (i.e., GLA:EPA ratios range from 0.89-2.1:1 [see Table 10]). It is expected that production of a specific lipid profile in the EPA-producing *Y. lipolytica* strains will be readily possible by manipulating expression levels of each desaturase and elongase that is utilized in the engineered ω-3/ω-6 fatty acid biosynthetic pathway, based on the teachings herein, as future clinical studies provide definition concerning preferred dosages of GLA and EPA.

DESCRIPTION OF PREFERRED EMBODIMENTS

The present invention demonstrates the synthesis of up to 28% EPA in the total lipid fraction of the oleaginous yeast, *Yarrowia lipolytica*. As shown in FIG. 5, numerous strains of *Y. lipolytica* were created by integrating various genes into wildtype ATCC #20362 *Y. lipolytica*, wherein each transformant strain was capable of producing different amounts of PUFAs (including EPA). The complete lipid profile of some representative transformant organisms expressing the ω-6 Δ6 desaturase/Δ6 elongase pathway are shown below in Table 10. Fatty acids are identified as 16:0, 16:1, 18:0, 18:1 (oleic acid), 18:2 (LA), GLA, DGLA, ARA, ETA and EPA; and the composition of each is presented as a % of the total fatty acids. "Lipid % dcw" represents the percentage of lipids in the cell, as measured by dry cell weight.

TABLE 10

Lipid Profile Of Representative *Yarrowia lipolytica* Strains Expressing The ω-6 Δ6 Desaturase/Δ6 Elongase Pathway

| Strain | Number Of Genes Added | | | | | | | Gene KOs | Fatty Acid Content | | | | | | | | | | Lipid % dcw |
|---|---|---|---|---|---|---|---|---|---|---|---|---|---|---|---|---|---|---|---|
| | Δ12 | Δ6 | ELO1 | ELO2 | Δ5 | Δ17 | $C_{16}$ ELO | | 16:0 | 16:1 | 18:0 | 18:1 | 18:2 | GLA | DGLA | ARA | ETA | EPA | |
| M4 | 1 | 1 | 1 | 1 | — | — | — | Ura | 15 | 4 | 2 | 5 | 27 | 35 | 8 | 0 | 0 | 0 | — |
| EU | 1 | 1 | 1 | 1 | 2 | 3 | — | Aco3, Ura | 19 | 10.3 | 2.3 | 15.8 | 12 | 18.7 | 5.7 | 0.2 | 3 | 10.3 | 36 |
| Y2072 | 2 | 1 | 2 | 1 | 4 | 3 | 1 | Aco3, Δ12 | 7.6 | 4.1 | 2.2 | 16.8 | 13.9 | 27.8 | 3.7 | 1.7 | 2.2 | 15 | — |
| Y2102 | 3 | 2 | 3 | 1 | 3 | 3 | 2 | Aco3, Δ12, Lip1 | 9 | 3 | 3.5 | 5.6 | 18.6 | 29.6 | 3.8 | 2.8 | 2.3 | 18.4 | — |
| Y2088 | 3 | 2 | 3 | 1 | 4 | 3 | 1 | Aco3, Δ12, Lip1 | 17 | 4.5 | 3 | 2.5 | 10 | 20 | 3 | 2.8 | 1.7 | 20 | — |
| Y2089 | 3 | 2 | 3 | 1 | 5 | 3 | 2 | Aco3, Δ12, Lip1 | 7.9 | 3.4 | 2.5 | 9.9 | 14.3 | 37.5 | 2.5 | 1.8 | 1.6 | 17.6 | — |
| Y2095 | 3 | 2 | 3 | 1 | 6 | 3 | 1 | Aco3, Δ12, Lip1 | 13 | 0 | 2.6 | 5.1 | 16 | 29.1 | 3.1 | 1.9 | 2.7 | 19.3 | — |

TABLE 10-continued

Lipid Profile Of Representative *Yarrowia lipolytica* Strains Expressing The ω-6 Δ6 Desaturase/Δ6 Elongase Pathway

| | Number Of Genes Added | | | | | | $C_{16}$ ELO | Gene KOs | Fatty Acid Content | | | | | | | | | | Lipid % dcw |
|---|---|---|---|---|---|---|---|---|---|---|---|---|---|---|---|---|---|---|---|
| Strain | Δ12 | Δ6 | ELO1 | ELO2 | Δ5 | Δ17 | | | 16:0 | 16:1 | 18:0 | 18:1 | 18:2 | GLA | DGLA | ARA | ETA | EPA | |
| Y2090 | 3 | 2 | 3 | 1 | 4 | 3 | 3 | Aco3. Δ12, Lip1 | 6 | 1 | 6.1 | 7.7 | 12.6 | 26.4 | 6.7 | 2.4 | 3.6 | 26.6 | 22.9 |
| Y2096 | 3 | 2 | 3 | 1 | 5 | 3 | 2 | Aco3. Δ12, Lip1 | 8.1 | 1 | 6.3 | 8.5 | 11.5 | 25 | 5.8 | 2.1 | 2.5 | 28.1 | 20.8 |

As seen in the Table above, the strain expressing the ω-6 Δ6 desaturase/Δ6 elongase pathway and producing the most EPA was recombinant strain Y2096 of *Yarrowia lipolytica*; the GC chromatogram obtained for this organism is shown in FIG. 6. A more detailed summary of the genetic modifications contained within strain Y2096 are described below (wherein complete details are provided in the Examples):

(1) Expression of 2 copies of a *Fusarium moniliforme* Δ12 desaturase, within FBA::F.Δ12::LIP2 and TEF::F.Δ12::PEX16 chimeric genes;

(2) Expression of 1 copy of a *Mortierella isabellina* Δ12 desaturase, within a FBAIN::M.D12::PEX20 chimeric gene;

(3) Expression of 2 copies of a synthetic Δ6 desaturase gene (codon-optimized for expression in *Y. lipolytica*) derived from a *Mortierella alpina* Δ6 desaturase, within TEF::Δ6S::LIP1 and FBAIN::Δ6S::LIP1 chimeric genes;

(4) Expression of 2 copies of a *Mortierella alpina* Δ5 desaturase, within FBAIN::MAΔ5S::PEX20 and TEF::MAΔ5S::LIP1 chimeric genes;

(5) Expression of 2 copies of a synthetic Δ5 desaturase gene (codon-optimized for expression in *Y. lipolytica*) derived from a *Homo sapiens* Δ5 desaturase, within TEF::H.D5S::PEX16 and GPAT::H.D5S::PEX20 chimeric genes;

(6) Expression of 1 copy of a synthetic Δ5 desaturase gene (codon-optimized for expression in *Y. lipolytica*) derived from a *Isochrysis galbana* Δ5 desaturase, within a TEF::I.D5S::PEX20 chimeric gene;

(7) Expression of 3 copies of a synthetic Δ17 desaturase gene (codon-optimized for expression in *Y. lipolytica*) derived from a *Saprolegnia diclina* Δ17 desaturase, within FBAIN::Δ17S::LIP2, TEF::Δ17S::PEX20 and FBAINm::Δ17S::PEX16 chimeric genes;

(8) Expression of 3 copies of a synthetic high affinity $C_{18/20}$ elongase gene (codon-optimized for expression in *Y. lipolytica*) derived from a *Mortierella alpina* high affinity $C_{18/20}$ elongase, within FBAIN::EL1S::PEX20, GPAT::EL1S::XPR and GPDIN::EL1S::LIP2 chimeric genes;

(9) Expression of 1 copy of a synthetic $C_{18/20}$ elongase gene (codon-optimized for expression in *Y. lipolytica*) derived from a *Thraustochytrium aureum* $C_{18/20}$ elongase, within a TEF::EL2S::XPR chimeric gene;

(10) Expression of 2 copies of a synthetic $C_{16/18}$ elongase gene (codon-optimized for expression in *Y. lipolytica*) derived from a *Rattus norvegicus* rELO gene, within TEF::rELO2S::PEX20 chimeric genes;

(11) Disruption of a native *Y. lipolytica* gene encoding Δ12 desaurase;

(12) Disruption of a native *Y. lipolytica* Pox3 gene encoding acyl-CoA oxidase 3; and,

(13) Disruption of a native *Y. lipolytica* Lip1 gene encoding lipase 1.

Similarly, the strain expressing the ω-6 Δ9 elongase/Δ8 desaturase pathway and producing the most EPA (i.e., 9%) was recombinant strain Y2201 of *Yarrowia lipolytica*. The complete lipid profile of this strain is shown below, wherein fatty acids are identified as 16:0, 16:1, 18:0, 18:1 (oleic acid), 18:2 (LA), 20:2 (EDA), DGLA, ARA, ETA and EPA (and the composition of each is presented as a % of the total fatty acids).

TABLE 11

Lipid Profile Of *Yarrowia lipolytica* Strain Y2201

| | Fatty Acid Content | | | | | | | | | |
|---|---|---|---|---|---|---|---|---|---|---|
| | 16:0 | 16:1 | 18:0 | 18:1 | 18:2 | 20:2 | DGLA | ARA | ETA | EPA |
| Strain Y2201 | 11.0 | 16.1 | 0.7 | 18.4 | 27.0 | 3.3 | 3.3 | 1.0 | 3.8 | 9.0 |

A summary of the genetic modifications contained within strain Y2201 are described below (wherein complete details are provided in the Examples):

(1) Expression of 1 copy of a *Fusarium moniliforme* Δ12 desaturase, within a FBAIN::F.D12S::Pex20 chimeric gene;

(2) Expression of 1 copy of a synthetic $C_{16/18}$ elongase gene (codon-optimized for expression in *Y. lipolytica*) derived from a *Rattus norvegicus* rELO gene, within a GPM/FBAintron::rELO2S::Oct chimeric gene;

(3) Expression of 5 copies of a synthetic Δ9 elongase gene (codon-optimized for expression in *Y. lipolytica*) derived from a *Isochrysis galbana* Δ9 elongase gene, within GPAT::IgD9e::Pex20, TEF::IgD9e::Lip1 and FBAINm::IgD9e::OCT chimeric genes;

(4) Expression of 3 copies of a synthetic Δ8 desaturase gene (codon-optimized for expression in *Y. lipolytica*)

derived from a *Euglena gracilis* Δ8 desaturase gene, within FBAIN::D8SF::Pex16 and GPD::D8SF::Pex16 chimeric genes;

(5) Expression of 2 copies of a *Mortierella alpina* Δ5 desaturase, within FBAIN::MAΔ5::Pex20 and GPAT:: MAΔ5::Pex20 chimeric genes;

(6) Expression of 2 copies of a synthetic Δ5 desaturase gene (codon-optimized for expression in *Y. lipolytica*) derived from a *Isochrysis galbana* Δ5 desaturase, within GPM/FBAIN::I.Δ5S::Oct and YAT1::I.D5S::Lip1 chimeric genes;

(7) Expression of 2 copies of a synthetic Δ17 desaturase gene (codon-optimized for expression in *Y. lipolytica*) derived from a *Saprolegnia diclina* Δ17 desaturase, within YAT1::D17S::Lip2 and GPD::D17S::Lip2 chimeric genes;

(8) Disruption of a native *Y. lipolytica* Pox2 gene encoding acyl-CoA oxidase2;

(9) Disruption and re-integration of a native *Y. lipolytica* Ura3 gene encoding orotidine-5'-phosphate decarboxylase; Disruption of a native *Y. lipolytica* Lys5 gene encoding saccharopine dehydrogenase; and,

(10) Disruption and re-integration of a native *Y. lipolytica* Leu2 gene encoding isopropyl malate dehydrogenase.

Finally, the strain expressing the ω-3 Δ9 elongase/Δ8 desaturase pathway and producing the most EPA (i.e., 1.3%) was recombinant strain L116 of *Yarrowia lipolytica*. The complete details concerning this strain and its complete lipid profile are provided in Example 18; a summary of the genetic modifications contained within strain L116 are described below:

(1) Expression of 5 copies of a *Fusarium moniliforme* Δ15 desaturase, within FBAIN::FmD15:Lip2 and GPD:: FmD15:XPR chimeric genes;

(2) Expression of 1 copy of a *Fusarium moniliforme* Δ12 desaturase, within a FBAIN::FmD12::Lip2 chimeric gene;

(3) Expression of 2 copies of a synthetic Δ9 elongase gene (codon-optimized for expression in *Y. lipolytica*) derived from a *Isochrysis galbana* Δ9 elongase gene, within a GPAT::D9E::Lip1 chimeric gene;

(4) Expression of 2 copies of a synthetic Δ8 desaturase gene (codon-optimized for expression in *Y. lipolytica*) derived from a *Euglena gracilis* Δ8 desaturase gene, within a FBAIN::D8:Pex16 chimeric gene; and, (5) Expression of 1 copy of a synthetic bifunctional Δ5/Δ6 desaturase gene derived from a *Danio rerio* Δ5/Δ6 desaturase, with a FBAIN::DrD6:Pex20 chimeric gene.

Although the Applicants demonstrate production of 28.1% EPA, 9% EPA, and 1.3% EPA, respectively, in these particular recombinant strains of *Yarrowia lipolytica*, it is contempalted that the concentration of EPA in the host cells could be significantly increased via additional genetic modifications, according to the invention herein. Furthermore, on the basis of the teachings and results described herein, it is expected that one skilled in the art will recognize the feasibility and commercial utility created by using oleaginous yeast as a production platform for the synthesis of a variety of ω-3 and/or ω-6 PUFAs, using the ω-6 Δ6 desaturase/Δ6 elongase pathway and/or the ω-3 Δ6 desaturase/Δ6 elongase pathway and/or the ω-6 Δ9 elongase/Δ8 desaturase pathway and/or the ω-3 Δ9 elongase/Δ8 desaturase pathway.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Standard recombinant DNA and molecular cloning techniques used in the Examples are well known in the art and are described by: 1.) Sambrook, J., Fritsch, E. F. and Maniatis, T. *Molecular Cloning: A Laboratory Manual*; Cold Spring Harbor Laboratory: Cold Spring Harbor, N.Y. (1989) (Maniatis); 2.) T. J. Silhavy, M. L. Bennan, and L. W. Enquist, Experiments with Gene Fusions; Cold Spring Harbor Laboratory: Cold Spring Harbor, N.Y. (1984); and 3.) Ausubel, F. M. et al., Current Protocols in Molecular Biology, published by Greene Publishing Assoc. and Wiley-Interscience (1987).

Materials and methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, $2^{nd}$ ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), GIBCO/BRL (Gaithersburg, Md.), or Sigma Chemical Company (St. Louis, Mo.), unless otherwise specified.

*E. coli* (XL1-Blue) competent cells were purchased from the Stratagene Company (San Diego, Calif.). *E. coli* strains were typically grown at 37° C. on Luria Bertani (LB) plates.

General molecular cloning was performed according to standard methods (Sambrook et al., supra). Oligonucleotides were synthesized by Sigma-Genosys (Spring, Tex.). Individual PCR amplification reactions were carried out in a 50 μl total volume, comprising: PCR buffer (containing 10 mM KCl, 10 mM $(NH_4)_2SO_4$, 20 mM Tris-HCl (pH 8.75), 2 mM $MgSO_4$, 0.1% Triton X-100), 100 μg/mL BSA (final concentration), 200 μM each deoxyribonucleotide triphosphate, 10 pmole of each primer and 1 μl of Pfu DNA polymerase (Stratagene, San Diego, Calif.), unless otherwise specified. Site-directed mutagenesis was performed using Stratagene's QuickChange™ Site-Directed Mutagenesis kit, per the manufacturers' instructions. When PCR or site-directed mutagenesis was involved in subcloning, the constructs were sequenced to confirm that no errors had been introduced to the sequence. PCR products were cloned into Promega's pGEM-T-easy vector (Madison, Wis.).

DNA sequence was generated on an ABI Automatic sequencer using dye terminator technology (U.S. Pat. No. 5,366,860; EP 272,007) using a combination of vector and insert-specific primers. Sequence editing was performed in Sequencher (Gene Codes Corporation, Ann Arbor, Mich.). All sequences represent coverage at least two times in both directions. Comparisons of genetic sequences were accomplished using DNASTAR software (DNA Star, Inc.). Alternatively, manipulations of genetic sequences were accomplished using the suite of programs available from the Genetics Computer Group Inc. (Wisconsin Package Version 9.0, Genetics Computer Group (GCG), Madison, Wis.). The GCG program "Pileup" was used with the gap creation default value of 12, and the gap extension default value of 4.

The GCG "Gap" or "Bestfit" programs were used with the default gap creation penalty of 50 and the default gap extension penalty of 3. Unless otherwise stated, in all other cases GCG program default parameters were used.

BLAST (Basic Local Alignment Search Tool; Altschul, S. F., et al., *J. Mol. Biol.* 215:403-410 (1993) and *Nucleic Acids Res.* 25:3389-3402 (1997)) searches were conducted to identity isolated sequences having similarity to sequences contained in the BLAST "nr" database (comprising all non-redundant GenBank CDS translations, sequences derived from the 3-dimensional structure Brookhaven Protein Data Bank, the SWISS-PROT protein sequence database, EMBL and DDBJ databases). Sequences were translated in all reading frames and compared for similarity to all publicly available protein sequences contained in the "nr" database, using the BLASTX algorithm (Gish, W. and States, D. *J. Nature Genetics* 3:266-272 (1993)) provided by the NCBI.

The results of BLAST comparisons summarizing the sequence to which a query sequence had the most similarity are reported according to the % identity, % similarity, and Expectation value. "% Identity" is defined as the percentage of amino acids that are identical between the two proteins. "% Similarity" is defined as the percentage of amino acids that are identical or conserved between the two proteins. "Expectation value" estimates the statistical significance of the match, specifying the number of matches, with a given score, that are expected in a search of a database of this size absolutely by chance.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s), and "kB" means kilobase(s).

Transformation and Cultivation of *Yarrowia Lipolytica*

*Yarrowia lipolytica* strains ATCC #20362, #76982 and #90812 were purchased from the American Type Culture Collection (Rockville, Md.). *Y. lipolytica* strains were usually grown at 28° C. on YPD agar (1% yeast extract, 2% bactopeptone, 2% glucose, 2% agar). Alternatively, "SD" media comprises: 0.67% yeast nitrogen base with ammonium sulfate, without amino acids and 2% glucose.

Transformation of *Y. lipolytica* was performed according to the method of Chen, D. C. et al. (*Appl. Microbiol Biotechnol.* 48(2):232-235 (1997)), unless otherwise noted. Briefly, *Yarrowia* was streaked onto a YPD plate and grown at 30° C. for approximately 18 hr. Several large loopfuls of cells were scraped from the plate and resuspended in 1 mL of transformation buffer containing: 2.25 mL of 50% PEG, average MW 3350; 0.125 mL of 2 M Li acetate, pH 6.0; 0.125 mL of 2 M DTT; and 50 μg sheared salmon sperm DNA. Then, approximately 500 ng of linearized plasmid DNA was incubated in 100 μl of resuspended cells, and maintained at 39° C. for 1 hr with vortex mixing at 15 min intervals. The cells were plated onto selection media plates and maintained at 30° C. for 2 to 3 days.

For selection of transformants, SD medium or minimal medium ("MM") was generally used; the composition of MM is as follows: 0.17% yeast nitrogen base (DIFCO Laboratories, Detroit, Mich.) without ammonium sulfate or amino acids, 2% glucose, 0.1% proline, pH 6.1). Supplements of adenine, leucine, lysine and/or uracil were added as appropriate to a final concentration of 0.01% (thereby producing "MMA", "MMLe", "MMLy" and "MMU" selection media, each prepared with 20 g/L agar).

Alternatively, transformants were selected on 5-fluoroorotic acid ("FOA"; also 5-fluorouracil-6-carboxylic acid monohydrate) selection media, comprising: 0.17% yeast nitrogen base (DIFCO Laboratories) without ammonium sulfate or amino acids, 2% glucose, 0.1% proline, 75 mg/L uracil, 75 mg/L uridine, 900 mg/L FOA (Zymo Research Corp., Orange, Calif.) and 20 g/L agar.

Finally, for the "two-stage growth conditions" designed to promote conditions of oleaginy, High Glucose Media ("HGM") was prepared as follows: 14 g/L $KH_2PO_4$, 4 g/L $K_2HPO_4$, 2 g/L $MgSO_4.7H_2O$, 80 g/L glucose (pH 6.5). Strains were cultured under "two-stage growth conditions" according to the following protocol: first, cells were grown in triplicate in liquid MM at 30° C. with shaking at 250 rpm/min for 48 hrs. The cells were collected by centrifugation and the liquid supernatant was extracted. The pelleted cells were resuspended in HGM and grown for either 72 hrs or 96 hrs at 30° C. with shaking at 250 rpm/min. The cells were again collected by centrifugation and the liquid supernatant was extracted.

A modified media used for the "modified two-stage growth conditions" was "SD+AA" media, which consisted of the following: 6.7 g Yeast Nitrogen Base without amino acids, but with ammonium sulfate, 20 g glucose, and 1× amino acid mix (20 mg/mL adenine sulfate, 20 mg/mL uracil, 20 mg/mL L-tryptophan, 20 mg/mL L-histidine-HCL, 20 mg/mL L-arginine-HCL, 20 mg/mL L-methionine, 30 mg/mL L-tyrosine, 30 mg/mL L-leucine, 30 mg/mL L-isoleucine, 30 mg/mL L-lysine-HCl, 50 mg/mL L-phenylalanine, 100 mg/mL L-glutamic acid, 100 mg/mL L-aspartic acid, 150 mg/mL L-valine, 200 mg/mL L-threonine and 400 mg/mL L-serine).

Fatty Acid Analysis of *Yarrowia Lipolytica*

For fatty acid analysis, cells were collected by centrifugation and lipids were extracted as described in Bligh, E. G. & Dyer, W. J. (*Can. J. Biochem. Physiol.* 37:911-917 (1959)). Fatty acid methyl esters were prepared by transesterification of the lipid extract with sodium methoxide (Roughan, G., and Nishida I. *Arch Biochem Biophys.* 276(1):38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 μl of 1%) was added to the sample, and then the sample was vortexed and rocked for 20 min. After adding 3 drops of 1 M NaCl and 400 μl hexane, the sample was vortexed and spun. The upper layer was removed and analyzed by GC as described above.

Example 1

Identification of Promoters for High Expression in *Yarrowia lipolytica*

Comparative studies investigating the promoter activities of the TEF, GPD, GPDIN, GPM, GPAT, FBA, FBAIN and YAT1 promoters were performed, by synthesizing constructs comprising each promoter and the *E. coli* gene encoding β-glucuronidase (GUS) as a reporter gene (Jefferson, R. A. *Nature.* 14(342):837-838 (1989)). Then, GUS activity was measured by histochemical and fluorometric assays (Jefferson, R. A. *Plant Mol. Biol. Reporter* 5:387-405 (1987)) and/or by using Real Time PCR for mRNA quantitation.

Construction of Plasmids Comprising a Chimeric Promoter::GUS::XPR Gene

Plasmid pY5-30 (FIG. 7A; SEQ ID NO:126) contained: a *Yarrowia* autonomous replication sequence (ARS18); a ColE1 plasmid origin of replication; an ampicillin-resistance gene (AmP$^R$), for selection in *E. coli*; a *Yarrowia* LEU2 gene, for selection in *Yarrowia*; and a chimeric TEF::GUS::XPR gene. Based on this plasmid, a series of plasmids were created wherein the TEF promoter was replaced with a variety of other native *Y. lipolytica* promoters.

The putative promoter regions were amplified by PCR, using the primers shown below in Table 12 and either genomic *Y. lipolytica* DNA as template or a fragment of genomic DNA containing an appropriate region of DNA cloned into the pGEM-T-easy vector (Promega, Madison, Wis.).

TABLE 12

Construction of Plasmids Comprising A Chimeric Promoter::GUS::XPR Gene

| Promoter | Primers | Location With Respect to Gene | RE Sites | Plasmid Name |
|---|---|---|---|---|
| GPD | YL211, YL212 (SEQ ID NOs: 184 and 185) | −968 bp to the 'ATG' translation initiation site of the gpd gene (SEQ ID NO: 173) | SalI and NcoI | pYZGDG |
| GPDIN | YL376, YL377 (SEQ ID NOs: 186 and 187) | −973 bp to +201 bp around the the gpd gene (thereby including a 146 bp intron wherein the intron is located at position +49 bp to +194 bp) (SEQ ID NO: 174) | PstI/NcoI (for promoter) and PstI/SalI (for vector) | pDMW222 |
| GPM | YL203, YL204 (SEQ ID NOs: 188 and 189) | −875 bp to the 'ATG' translation initiation site of the gpm gene (SEQ ID NO: 175) | NcoI and SalI | pYZGMG |
| GPAT | GPAT-5-1, GPAT-5-2 (SEQ ID NOs: 190 and 191) | −1130 bp to the 'ATG' translation initiation site of the gpat gene (SEQ ID NO: 179) | SalI and NcoI | pYGPAT-GUS |
| FBA | ODMW314, YL341 (SEQ ID NOs: 192 and 193) | −1001 bp to −1 bp around the fba gene (SEQ ID NO: 176) | NcoI and SalI | pDMW212 |
| FBAIN | ODMW320, ODMW341 (SEQ ID NOs: 194 and 195) | −804 bp to +169 bp around the fba gene (thereby including a 102 bp intron wherein the intron is located at position +62 bp to +165 bp) (SEQ ID NO: 177) | NcoI and SalI | pDMW214 |
| YAT1 | 27203-F, 27203-R (SEQ ID NOs: 196 and 197) | −778 bp to −1 bp around the yat1 gene (SEQ ID NO: 180) | HindIII and SalI; also NcoI and HindIII | pYAT-GUS |

Note:
The 'A' nucleotide of the 'ATG' translation initiation codon was designated as +1.

The individual PCR amplification reactions for GPD, GPDIN, GPM, FBA and FBAIN were carried out in a 50 μl total volume, as described in the General Methods. The thermocycler conditions were set for 35 cycles at 95° C. for 1 min, 56° C. for 30 sec and 72° C. for 1 min, followed by a final extension at 72° C. for 10 min.

The PCR amplification for the GPAT promoter was carried out in a 50 μl total volume using a 1:1 dilution of a premixed 2×PCR solution (TaKaRa Bio Inc., Otsu, Shiga, 520-2193, Japan). The final composition contained 25 mM TAPS (pH 9.3), 50 mM KCl, 2 mM MgCl$_2$, 1 mM 2-mercaptoethanol, 200 μM each deoxyribonucleotide triphosphate, 10 pmole of each primer, 50 ng template and 1.25 U of TaKaRa Ex Taq™ DNA polymerase (Takara Mirus Bio, Madison, Wis.). The thermocycler conditions were set for 30 cycles at 94° C. for 2.5 min, 55° C. for 30 sec and 72° C. for 2.5 min, followed by a final extension at 72° C. for 6 min.

The PCR amplification for the YAT1 promoter was carried out in a composition comparable to that described above for GPAT. The reaction mixture was first heated to 94° C. for 150 sec. Amplification was carried out for 30 cycles at 94° C. for 30 sec, 55° C. for 30 sec and 72° C. for 1 min, followed by a final extension for 7 min at 72° C.

Each PCR product was purified using a Qiagen PCR purification kit and then digested with restriction enzymes (according to the Table above using standard conditions) and the digested products were purified following gel electrophoresis in 1% (w/v) agarose. The digested PCR products (with the exception of those from YAT1) were then ligated into similarly digested pY5-30 vector. Ligated DNA from each reaction was then used to individually transform *E. coli* Top10, *E. coli* DH10B or *E. coli* DH5α. Transformants were selected on LB agar containing ampicillin (100 μg/mL).

YAT1 required additional manipulation prior to cloning into pY5-30. Specifically, upon digestion of the YAT1 PCR product with HindIII and SalI, a ~600 bp fragment resulted; digestion with NcoI and HindIII resulted in a ~200 bp fragment. Both products were isolated and purified. Then, plasmid pYGPAT-GUS was digested with SalI and NcoI, and a ~9.5 kB fragment was isolated and purified. The three DNA fragments were ligated together to create pYAT-GUS.

Analysis of the plasmid DNA from each transformation reaction confirmed the presence of the expected plasmid. These plasmids were designated as follows: PYZGDG (comprising a GPD::GUS::XPR chimeric gene), pDMW222 (comprising a GPDIN::GUS::XPR chimeric gene), pYZGMG (comprising a GPM::GUS::XPR chimeric gene), pYGPAT-GUS (comprising a GPAT::GUS::XPR chimeric gene), pDMW212 (comprising a FBA::GUS::XPR chimeric gene), pDMW214 (comprising a FBAIN::GUS::XPR chimeric gene) and pYAT-GUS (comprising a YAT1::GUS::XPR chimeric gene).

Each of the plasmids above, and additionally plasmid pY5-30 (comprising a TEF::GUS::XPR chimeric gene), was transformed separately into *Y. lipolytica* as described in the General Methods. The *Y. lipolytica* host was either *Y. lipolytica* ATCC #76982 or *Y. lipolytica* ATCC #20362, strain Y2034 (infra [Example 4], capable of producing 10% ARA via the Δ6 desaturase/Δ6 elongase pathway). All transformed cells were plated onto minimal media plates lacking leucine and maintained at 30° C. for 2 to 3 days.

Comparative Analysis of *Yarrowia* Promoters by Histochemical Analysis of GUS Expression

*Yarrowia lipolytica* ATCC #76982 strains containing plasmids pY5-30, pYZGDG, pYZGMG, pDMW212 and pDMW214 were grown from single colonies in 3 mL MM at 30° C. to an $OD_{600}$~1.0. Then, 100 µl of cells were collected by centrifugation, resuspended in 100 µl of histochemical staining buffer, and incubated at 30° C. Staining buffer was prepared by dissolving 5 mg of 5-bromo-4-chloro-3-indolyl glucuronide (X-Gluc) in 50 µl dimethyl formamide, followed by the addition of 5 mL 50 mM $NaPO_4$, pH 7.0. The results of histochemical staining (FIG. 7B) showed that the TEF promoter in construct pY5-30, the GPD promoter in construct pYZGDG, the GPM promoter in construct pYZGMG, the FBA promoter in construct pDMW212, and the FBAIN promoter in construct pDMW214 were all active. Both the FBA and FBAIN promoters appeared to be much stronger than all the other promoters, with the FBAIN promoter having the strongest promoter activity.

In a separate experiment, *Y. lipolytica* Y2034 strains containing plasmids pY5-30, PYGPAT-GUS, PYAT-GUS and pDMW214 were grown from single colonies in 5 mL SD media at 30° C. for 24 hrs to an $OD_{600}$~8.0. Then, 1 mL of cells were collected by centrifugation. The remaining cultures were centrifuged and washed 2× with HGM, resuspended in 5 mL each of HGM and allowed to grow at 30° C. further. After 24 and 120 hrs, ~0.25 mL of each culture were centrifuged to collect the cells. Cell samples were resuspended individually in 100 µl of histochemical staining buffer (supra). Zymolase 20T (5 µl of 1 mg/mL; ICN Biomedicals, Costa Mesa, Calif.) was added to each, and the mixture incubated at 30° C.

The results of histochemical staining showed that the GPAT promoter in construct pYGPAT-GUS was active, as was the YAT1 promoter in construct pYAT-GUS, when grown in SD medium for 24 hrs (FIG. 7C, "24 hr in SD medium"). Comparatively, the GPAT promoter appeared to be much stronger than the TEF promoter and had diminished activity with respect to the FBAIN promoter. Likewise, the YAT1 promoter appeared to be stronger than the TEF promoter but significantly weaker than the FBAIN promoter and GPAT promoter, when cells were grown in SD medium for 24 hrs. More interestingly, however, it appeared that the YAT1 promoter was stronger than the GPAT promoter and comparable with the FBAIN promoter in cells grown in HGM for 24 hrs (FIG. 7C, "24 hr in HG medium"). This remained true after 120 hrs in HGM (FIG. 7C, "120 hr in HG medium"). Thus, the YAT1 promoter appeared to be induced in HGM, a medium that promotes oleaginous growth conditions due to nitrogen limitation.

Comparative Analysis of *Yarrowia* Promoters by Fluorometric Assay of GUS Expression GUS activity was also assayed by fluorometric determination of the production of 4-methylumbelliferone (4-MU) from the corresponding substrate β-glucuronide (Jefferson, R. A. *Plant Mol. Biol. Reporter* 5:387-405 (1987)).

*Yarrowia lipolytica* ATCC #76982 strains containing plasmids pY5-30, PYZGDG, PYZGMG, pDMW212 and pDMW214 were grown from single colonies in 3 mL MM (as described above) at 30° C. to an $OD_{600}$~1.0. Then, the 3 mL cultures were each added to a 500 mL flask containing 50 mL MM and grown in a shaking incubator at 30° C. for about 24 hrs. The cells were collected by centrifugation, resuspended in Promega Cell Lysis Buffer and lysed using the BIO 101 Biopulverizer system (Vista, Calif.). After centrifugation, the supernatants were removed and kept on ice.

Similarly, *Y. lipolytica* strain Y2034 containing plasmids pY5-30, pYAT-GUS, pYGPAT-GUS and pDMW214 constructs, respectively, were grown from single colonies in 10 mL SD medium at 30° C. for 48 hrs to an $OD_{600}$~5.0. Two mL of each culture was collected for GUS activity assays, as described below, while 5 mL of each culture was switched into HGM.

Specifically, cells from the 5 mL aliquot were collected by centrifugation, washed once with 5 mL of HGM and resuspended in HGM. The cultures in HGM were then grown in a shaking incubator at 30° C. for 24 hrs. Two mL of each HGM culture were collected for the GUS activity assay, while the remaining culture was allowed to grow for an additional 96 hrs before collecting an additional 2 mL of each culture for the assay.

Each 2 mL culture sample in SD medium was resuspended in 1 mL of 0.5× cell culture lysis reagent (Promega). Resuspended cells were mixed with 0.6 mL of glass beads (0.5 mm diameter) in a 2.0 mL screw cap tube with a rubber O-ring. The cells were then homogenized in a Biospec mini bead-beater (Bartlesville, Okla.) at the highest setting for 90 sec. The homogenization mixtures were centrifuged for 2 min at 14,000 rpm in an Eppendof centrifuge to remove cell debris and beads. The supernatant was used for GUS assay and protein determination.

For each fluorometric assay, 100 µl of extract was added to 700 µl of GUS assay buffer (2 mM 4-methylumbelliferyl-β-D-glucuronide ("MUG") in extraction buffer) or 200 µl of extract was added to 800 µl of GUS assay buffer. The mixtures were placed at 37° C. Aliquots of 100 µl were taken at 0, 30 and 60 min time points and added to 900 µl of stop buffer (1 M $Na_2CO_3$). Each time point was read using a CytoFluor Series 4000 Fluorescence Multi-Well Plate Reader (PerSeptive Biosystems, Framingham, Mass.) set to an excitation wavelength of 360 nm and an emission wavelength of 455 nm. Total protein concentration of each sample was determined using 10 µl of extract and 200 µl of BioRad Bradford reagent or 20 µl of extract and 980 µl of BioRad Bradford reagent (Bradford, M. M. *Anal. Biochem.* 72:248-254 (1976)). GUS activity was expressed as nmoles of 4-MU per minute per mg of protein.

Results of these fluorometric assays designed to compare the TEF, GPD, GPM, FBA and FBAIN promoters in *Y. lipolytica* ATCC #76982 strains are shown in FIG. 8A. Specifically, the FBA promoter was 2.2 times stronger than the GPD promoter in *Y. lipolytica*. Additionally, the GUS activity of the FBAIN promoter was about 6.6 times stronger than the GPD promoter.

Results of these fluorometric assays designed to compare the TEF, GPAT, YAT1 and FBAIN promoters in *Y. lipolytica* strain Y2034 are shown in the Table below.

TABLE 13

Comparison of TEF, FBAIN, YAT1 And GPAT Promoter-Activity Under Various Growth Conditions

| Culture | Promoter | | | |
| --- | --- | --- | --- | --- |
| Conditions | TEF | FBAIN | YAT1 | GPAT |
| 48 hr, SD | 0.401 | 43.333 | 0.536 | 5.252 |
| 24 hr, HGM | 0.942 | 30.694 | 19.154 | 2.969 |
| 120 hr HGM | 0.466 | 17.200 | 13.400 | 3.050 |

Based on the data above wherein the activity of the YAT1 promoter was quantitated based on GUS activity of cell extracts, the activity of the YAT1 promoter increased by ~37 fold when cells were switched from SD medium into HGM and grown for 24 hrs. After 120 hrs in HGM, the activity was reduced somewhat but was still 25× higher than the activity in SD medium. In contrast, the activity of the FBAIN promoter and the GPAT promoter was reduced by 30% and 40%, respectively, when switched from SD medium into HGM for 24 hrs. The activity of the TEF promoter increased by 2.3 fold after 24 hrs in HGM. Thus, the YAT1 promoter is inducible under oleaginous conditions.

Comparative Analysis of *Yarrowia* Promoters by Quantitative PCR Analyses of GUS Expression The transcriptional activities of the TEF, GPD, GPDIN, FBA and FBAIN promoters were determined in *Y. lipolytica* containing the pY5-30, pYZGDG, pDMW222, pDMW212 and pDMW214 constructs by quantitative PCR analyses. This required isolation of RNA and real time RT-PCR.

More specifically, *Y. lipolytica* ATCC #76982 strains containing pY5-30, PYZGDG, pDMW222, pDMW212 and pDMW214 were grown from single colonies in 6 mL of MM in 25 mL Erlenmeyer flasks for 16 hrs at 30° C. Each of the 6 mL starter cultures was then added to individual 500 mL flasks containing 140 mL HGM and incubated at 30° C. for 4 days. In each interval of 24 hrs, 1 mL of each culture was removed from each flask to measure the optical density, 27 mL was removed and used for a fluorometric GUS assay (as described above), and two aliquots of 1.5 mL were removed for RNA isolation. The culture for RNA isolation was centrifuged to produce a cell pellet.

The RNA was isolated from *Yarrowia* strains according to the modified Qiagen RNeasy mini protocol (Qiagen, San Diego, Calif.). Briefly, at each time point for each sample, 340 µL of Qiagen's buffer RLT was used to resuspend each of the two cell pellets. The buffer RLT/cell suspension mixture from each of the two tubes was combined in a bead beating tube (Bio101, San Diego, Calif.). About 500 µL of 0.5 mL glass beads was added to the tube and the cells were disrupted by bead beating 2 min at setting 5 (BioPulverizer, Bio101 Company, San Diego, Calif.). The disrupted cells were then pelleted by centrifugation at 14,000 rpm for 1 min and 350 µl of the supernatent was transferred to a new microcentrifuge tube. Ethanol (350 µL of 70%) was added to each homogenized lysate. After gentle mixing, the entire sample was added to a RNeasy mini column in a 2 mL collection tube. The sample was centrifuged for 15 sec at 10,000 rpm. Buffer RW1 (350 µL) was added to the RNeasy mini column and the column was centrifuged for 15 sec at 10,000 rpm to wash the cells. The eluate was discarded. Qiagen's DNase1 stock solution (10 µL) was added to 70 µl of Buffer RDD and gently mixed. This entire DNase solution was added to the RNeasy mini column and incubated at room temperature for 15 min. After the incubation step, 350 µL of Buffer RW1 was added to the mini column and the column was centrifuged for 15 sec at 10,000 rpm. The column was washed twice with 700 µL Buffer RW1. RNase-free water (50 µL) was added to the column. The column was centrifuged for 1 min at 10,000 rpm to elute the RNA.

A two-step RT-PCR protocol was used, wherein total *Yarrowia* RNA was first converted to cDNA and then cDNA was analyzed using Real Time PCR. The conversion to cDNA was performed using Applied Biosystems' High Capacity cDNA Archive Kit (PN#4322171; Foster City, Calif.) and Molecular Biology Grade water from MediaTech, Inc. (PN# 46-000-Con; Holly Hill, Fla.). Total RNA from *Yarrowia* (100 ng) was converted to cDNA by combining it with 10 µl of RT buffer, 4 µl of 25×dNTPs, 10 µl 10× Random Hexamer primers, 5 µl Multiscribe Reverse Transcriptase and 0.005 µl RNase Inhibitor, and brought to a total reaction volume of 100 µl with water. The reactions were incubated in a thermocycler for 10 min at 25° C. followed by 2 hrs at 37° C. The cDNA was stored at −20° C. prior to Real Time analysis.

Real Time analysis was performed using the SYBR Green PCR Master Mix from Applied Biosystems (PN# 4309155). The Reverse Transcription reaction (2 µl) was added to 10 µl of 2×SYBR PCR Mix, 0.2 µl of 100 µM Forward and Reverse primers for either URA (i.e., primers YL-URA-16F and YL-URA-78R [SEQ ID NOs:198 and 199]) or GUS (i.e., primers GUS-767F and GUS-891R [SEQ ID NO:200 and 201]) and 7.2 µl water. The reactions were thermocycled for 10 min at 95° C. followed by 40 cycles of 95° C. for 5 sec and 60° C. for 1 min in an ABI 7900 Sequence Detection System instrument. Real time fluorescence data was collected during the 60° C. extension during each cycle.

Relative quantitation was performed using the $\Delta\Delta C_T$ method as per User Bulletin #2: "Relative Quantitation of Gene Expression", Applied Biosystems, Updated 10/2001. The URA gene was used for normalization of GUS expression. In order to validate the use of URA as a normalizer gene, the PCR efficiency of GUS and URA were compared and they were found to be 1.04 and 0.99, respectively (where 1.00 equals 100% efficiency). Since the PCR efficiencies were both near 100%, the use of URA as a normalizer for GUS expression was validated, as was the use of the $\Delta\Delta CT$ method for expression quantitation. The normalized quantity is referred to as the $\Delta CT$.

The GUS mRNA in each different strain (i.e., *Y. lipolytica* ATCC #76982 strains containing the PYZGDG, pDMW222, pDMW212 and pDMW214 constructs) was quantified to the mRNA level of the strain with pY5-30 (TEF::GUS). Thus, relative quantitation of expression was calculated using the mRNA level of the strain with TEF::GUS as the reference sample. The normalized value for GPD::GUS, GPDIN::GUS, FBA::GUS and FBAIN::GUS was compared to the normalized value of the TEF::GUS reference. This quantity is referred to as the $\Delta\Delta CT$. The $\Delta\Delta CT$ values were then converted to absolute values by utilizing the formula $2^{-\Delta\Delta CT}$. These values refer to the fold increase in the mRNA level of GUS in the strains comprising the chimeric GPD::GUS, GPDIN::GUS, FBA::GUS and FBAIN::GUS genes, as compared to the chimeric TEF::GUS gene. Using this methodology, it was possible to compare the activity of the TEF promoter to the GPD, GPDIN, FBA and FBAIN promoters.

The results of the relative quantitation of mRNA for each GUS chimeric gene are shown in FIG. 8B. More specifically, the assay showed that after 24 hrs in HGM, the transcription activity of FBA and FBAIN promoters was about 3.3 and 6 times stronger than the TEF promoter, respectively. Similarly, the transcription activity of the GPD and GPDIN promoters is about 2 and 4.4 times stronger than the TEF promoter, respectively. While the transcription activities of the FBA::GUS, FBAIN::GUS, GPD::GUS and GPDIN::GUS gene fusion decreased over the 4 day period of the experiment, the transcriptional activity of the FBAIN and GPDIN promoters was still about 3 and 2.6 times stronger than the TEF promoter in the final day of the experiment.

Example 2

Identification of Enhancers Useful to Increase Gene Transcription in *Yarrowia lipolytica*

Based on the strong promoter activities of FBAIN and GPDIN (wherein activity was greater than that of the FBA and GPD promoters, respectively) and the identification of an intron within each promoter region, the present work was conducted to determine whether enhancers were present in each intron.

Specifically, two chimeric promoters consisting of a GPM::FBAIN promoter fusion and a GPM::GPDIN promoter fusion were generated to drive expression of the GUS reporter gene. The chimeric promoters (comprised of a "component 1" and a "component 2") are described below in Table 14.

TABLE 14

Construction of Plasmids Comprising A Chimeric Promoter Within A Chimeric Promoter::GUS::XPR Gene

| Chimeric Promoter | Component 1 | Component 2 | Plasmid Name |
|---|---|---|---|
| GPM::FBAIN (SEQ ID NO: 182) | −1 bp to −843 bp region of GPM | +1 bp to +171 bp region of FBAIN, wherein the intron is located at position +62 bp to +165 bp | pDMW224 |
| GPM::GPDIN (SEQ ID NO: 183) | −1 bp to −843 bp region of GPM | +1 bp to +198 bp region of GPDIN, wherein the intron is located at position +49 bp to +194 bp | pDMW225 |

The chimeric promoters were positioned such that each drove expression of the GUS reporter gene in plasmids pDMW224 and pDMW225.

The activities of the GPM::FBAIN promoter and the GPM::GPDIN promoter were compared with the TEF, FBAIN, GPDIN and GPM promoters by comparing the GUS activity in *Y. lipolytica* strains comprising pDMW224 and pDMW225 relative to the GUS activity in *Y. lipolytica* strains comprising pY5-30, pYZGDG, pYZGMG and pDMW214 constructs based on results from histochemical assays (as described in Example 1). As previously determined, the FBAIN promoter was the strongest promoter. However, the chimeric GPM::FBAIN promoter and the chimeric GPM::GPDIN promoter were both much stronger than the GPM promoter and appeared to be equivalent in activity to the GPDIN promoter. Thus, this confirmed the existence of an enhancer in both the GPDIN promoter and the FBAIN promoter.

One skilled in the art would readily be able to construct similar chimeric promoters, using either the GPDIN intron or the FBAIN intron.

Example 3

Sulfonylurea Selection

Genetic improvement of *Yarrowia* has been hampered by the lack of suitable non-antibiotic selectable transformation markers. The present Example describes the development of a dominant, non antibiotic marker for *Y. lipolytica* based on sulfonylurea resistance that is also generally applicable to industrial yeast strains that may be haploid, diploid, aneuploid or heterozygous.

Theory and Initial Sensitivity Screening

Acetohydroxyacid synthase (AHAS) is the first common enzyme in the pathway for the biosynthesis of branched-chain amino acids. It is the target of the sulfonylurea and imidazolinone herbicides. As such, sulfonyl urea herbicide resistance has been reported in both microbes and plants. For example, in *Saccharomyces cerevisiae*, the single W586L mutation in AHAS confers resistance to sulfonylurea herbicides (Falco, S. C., et al., *Dev. Ind. Microbiol.* 30:187-194 (1989); Duggleby, R. G., et. al. *Eur. J. Biochem.* 270:2895 (2003)).

When the amino acid sequences of wild type AHAS *Y. lipolytica* (GenBank Accession No. XP_501277) and *S. cerevisiae* (GenBank Accession No. P07342) enzymes were aligned, the Trp amino acid residue at position 586 of the *S. cerevisiae* enzyme was equivalent to the Trp residue at position 497 of the *Y. lipolytica* enzyme. It was therefore hypothesized that W497L mutation in the *Y. lipolytica* enzyme would likely confer sulfonylurea herbicide resistance, if the wild type cells were themselves sensitive to sulfonylurea. Using methodology well known to those of skill in the art, it was determined that sulfonylurea (chlorimuron ethyl) at a concentration of 100 μg/mL in minimal medium was sufficient to inhibit growth of wild type *Y. lipolytica* strains ATCC #20362 and ATCC #90812.

Synthesis Of A Mutant W497L AHAS Gene

The *Y. lipolytica* AHAS gene containing the W497L mutation (SEQ ID NO:292) was created from genomic DNA in a two-step reaction. First, the 5' portion of the AHAS gene was amplified from genomic DNA using Pfu Ultra™ High-Fidelity DNA Polymerase (Stratagene, Catalog #600380) and primers 410 and 411 [SEQ ID NOs:396 and 397]; the 3' portion of the gene was amplified similarly using primers 412 and 413 [SEQ ID NOs:398 and 399]. The two pairs of primers were overlapping such that the overlapping region contained the W497L mutation (wherein the mutation was a 'CT' change to 'TG').

Figure 3B:
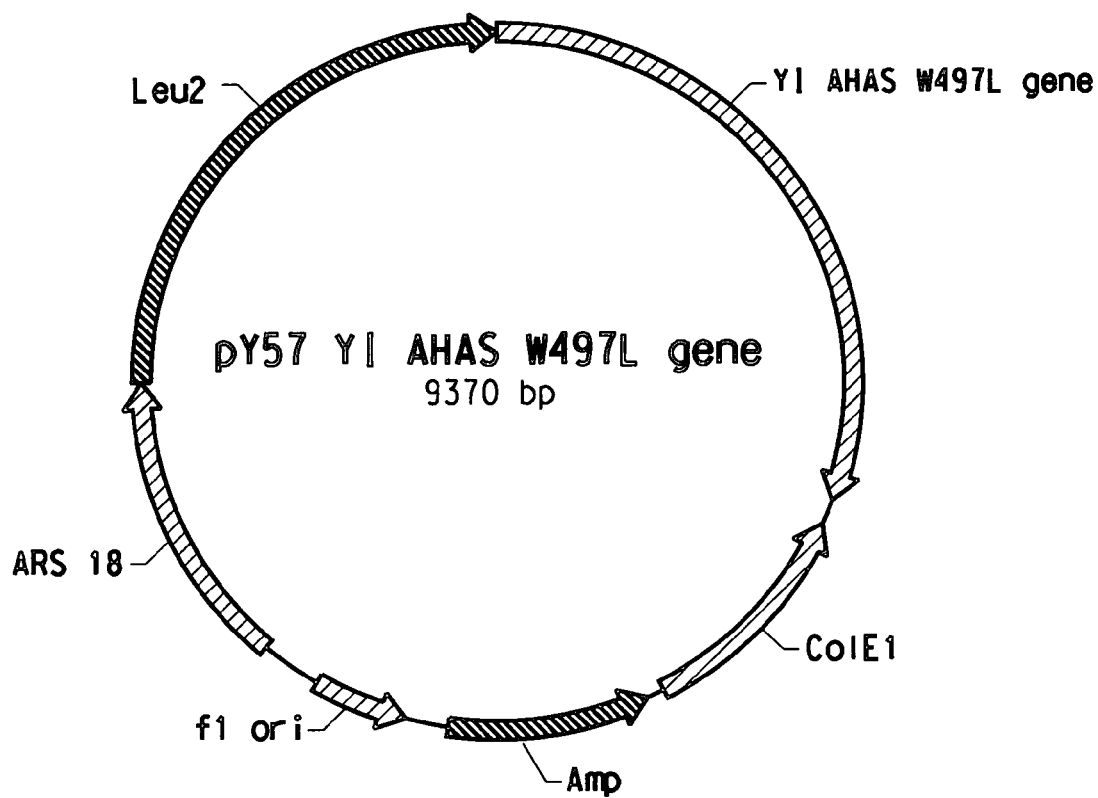
FIG. 3B provides a plasmid map for pY57.YI.AHAS.w497I.

The 5' and 3' PCR products of the correct size were gel purified and used as the template for the second round of PCR, wherein the entire mutant gene was amplified using primers 414 and 415 (SEQ ID NOs:400 and 401) and a mixture of the products from the two primary PCR reactions. This mutant gene carried its own native promoter and terminator sequences. The second round PCR product of the correct size was gel purified and cloned by an in-fusion technique into the vector backbone of plasmid pY35 [containing a chimeric TEF::*Fusarium moniliforme* Δ12 desaturase (Fm2) gene, the *E. coli* origin of replication, a bacterial ampicillin resistance gene, the *Yarrowia* Leu 2 gene and the *Yarrowia* autonomous replication sequence (ARS); see WO 2005/047485 for additional details], following its digestion with enzymes SalI/BsiWI. The in-fusion reaction mixture was transformed into TOP10 competent cells (Invitrogen, Catalog #C4040-10). After one day selection on LB/Amp plates, eight (8) colonies were analyzed by DNA miniprep. Seven clones were confirmed to be correct by restriction digest. One of them that contained the sulfonylurea resistance gene as well as the LEU gene was designated "pY57" (or "pY57.YI.AHAS.w4971"; FIG. 3B).

Wild type *Y. lipolytica* strains ATCC #90812 and #20362 were transformed with pY57 and 'empty' LEU by a standard Lithium Acetate method. Transformation controls comprising 'No-DNA' were also utilized. Transformants were plated onto either MM+sulfonylurea (SU; 100 µg/mL) agar plates and the presence or absence of colonies was evaluated following four days of growth.

TABLE 15

AHAS Selection In *Yarrowia lipolytica*

| Plasmid | ATCC #90812 | | ATCC #20362 | |
|---|---|---|---|---|
| | MM | MM + SU (100 µg/mL) | MM | MM + SU (100 µg/mL) |
| pY57 | colonies | colonies | colonies | colonies |
| Leu vector control | colonies | No colonies | colonies | No colonies |
| No DNA control | No colonies | No colonies | No colonies | No colonies |

Based on the results shown above, AHAS W497L was a good non-antibiotic selection marker in both *Y. lipolytica* ATCC #90812 and #20362. Subsequently, Applicants used a sulfonylurea concentration of 150 µg/mL. This new marker is advantageous for transforming *Y. lipolytica* since it does not rely on a foreign gene but on a mutant native gene and it neither requires auxotrophy nor results in auxotrophy. The herbicide is non-toxic to humans and animals.

It is expected that this selection method will be generally applicable to other industrial yeast strains that may be haploid, diploid, aneuploid or heterozygous, if mutant AHAS enzymes were created in a manner analogous to that described herein.

Example 4

The ω-6 Δ6 Desaturase/Δ6 Elongase Pathway: Generation of Y2067U Strain to Produce About 14% EPA of Total Lipids with Ura– Phenotype The present Example describes the construction of strain Y2067U, derived from *Yarrowia lipolytica* ATCC #20362, capable of producing 14% EPA relative to the total lipids (FIG. 5). This strain was engineered to express the ω-6 Δ6 desaturase/Δ6 elongase pathway. The effect of *M. alpina* LPMT2, DGAT1 and DGAT2 and *Y. lipolytica* CPT1 gene over-expression was examined in this EPA producing strain based on analysis of TAG content and/or composition, as described in Examples 20, 21, 22 and 27, respectively (infra).

The development of strain Y2067U required the construction of strain M4 (producing 8% DGLA), strain Y2034 (producing 10% ARA), strain E (producing 10% EPA), strain EU (producing 10% EPA) and strain Y2067 (producing 15% EPA).

Generation of M4 Strain to Produce About 8% DGLA of Total Lipids

Figure 9A:
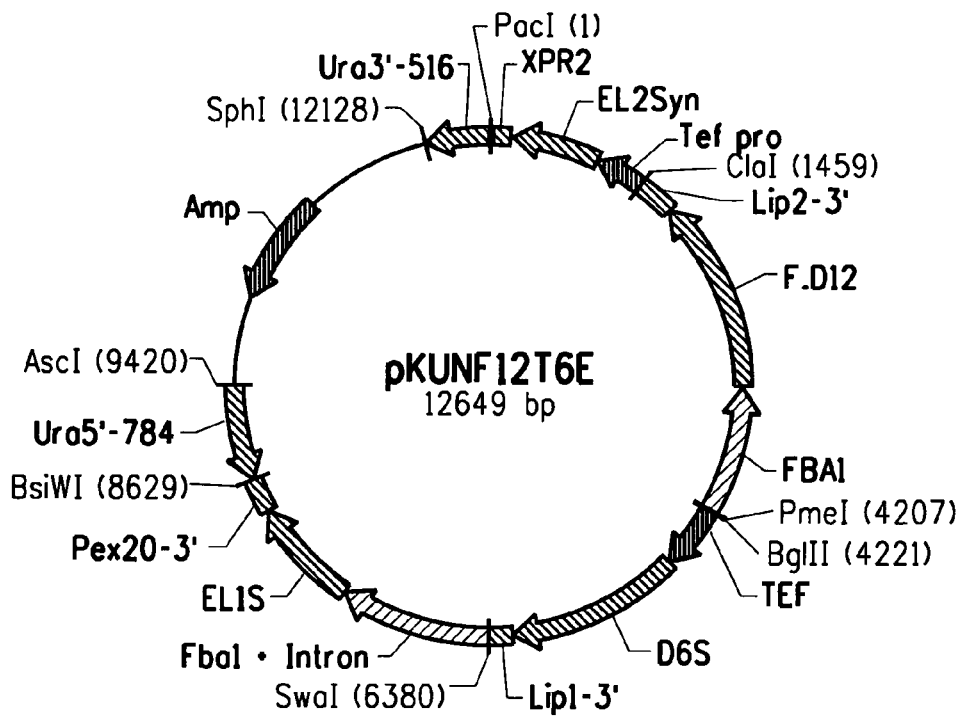

Construct pKUNF12T6E (FIG. 9A; SEQ ID NO:128) was generated to integrate four chimeric genes (comprising a Δ12 desaturase, a Δ6 desaturase and two $C_{18/20}$ elongases) into the Ura3 loci of wild type *Yarrowia* strain ATCC #20362, to thereby enable production of DGLA. The pKUNF12T6E plasmid contained the following components:

TABLE 16

Description of Plasmid pKUNF12T6E (SEQ ID NO: 128)

| RE Sites And Nucleotides Within SEQ ID NO: 128 | Description Of Fragment And Chimeric Gene Components |
|---|---|
| AscI/BsiWI (9420-8629) | 784 bp 5' part of *Yarrowia* Ura3 gene (GenBank Accession No. AJ306421) |
| SphI/PacI (12128-1) | 516 bp 3' part of *Yarrowia* Ura3 gene (GenBank Accession No. AJ306421) |
| SwaI/BsiWI (6380-8629) | FBAIN::EL1S::Pex20, comprising: FBAIN: FBAIN promoter (SEQ ID NO: 177) EL1S: codon-optimized elongase 1 gene (SEQ ID NO: 19), derived from *Mortierella alpina* (GenBank Accession No. AX464731) Pex20: Pex20 terminator sequence from *Yarrowia* Pex20 gene (GenBank Accession No. AF054613) |
| BglII/SwaI (4221-6380) | TEF::Δ6S::Lip1, comprising: TEF: TEF promoter (GenBank Accession No. AF054508) Δ6S: codon-optimized Δ6 desaturase gene (SEQ ID NO: 3), derived from *Mortierella alpina* (GenBank Accession No. AF465281) Lip1: Lip1 terminator sequence from *Yarrowia* Lip1 gene (GenBank Accession No. Z50020) |
| PmeI/ClaI (4207-1459) | FBA::F.Δ12::Lip2, comprising: FBA: FBA promoter (SEQ ID NO: 176) F.Δ12: *Fusarium moniliforme* Δ12 desaturase gene (SEQ ID NO: 27) Lip2: Lip2 terminator sequence from *Yarrowia* Lip2 gene (GenBank Accession No. AJ012632) |
| ClaI/PacI (1459-1) | TEF::EL2S::XPR, comprising: TEF: TEF promoter (GenBank Accession No. AF054508) EL2S: codon-optimized elongase gene (SEQ ID NO: 22), derived from *Thraustochytrium aureum* (U.S. Pat. No. 6,677,145) XPR: ~100 bp of the 3' region of the *Yarrowia* Xpr gene (GenBank Accession No. M17741) |

The pKUNF12T6E plasmid was digested with AscI/SphI, and then used for transformation of wild type *Y. lipolytica* ATCC #20362 according to the General Methods. The transformant cells were plated onto FOA selection media plates and maintained at 30° C. for 2 to 3 days. The FOA resistant colonies were picked and streaked onto MM and MMU selection plates. The colonies that could grow on MMU plates but not on MM plates were selected as Ura– strains. Single colonies of Ura– strains were then inoculated into liquid MMU at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of DGLA in the transformants containing the 4 chimeric genes of pKUNF12T6E, but not in the wild type *Yarrowia* control strain. Most of the selected 32 Ura⁻ strains produced about 6% DGLA of total lipids. There were 2 strains (i.e., strains M4 and 13-8) that produced about 8% DGLA of total lipids.

Generation of Y2034 Strain to Produce About 10% ARA of Total Lipids

Figure 9B:
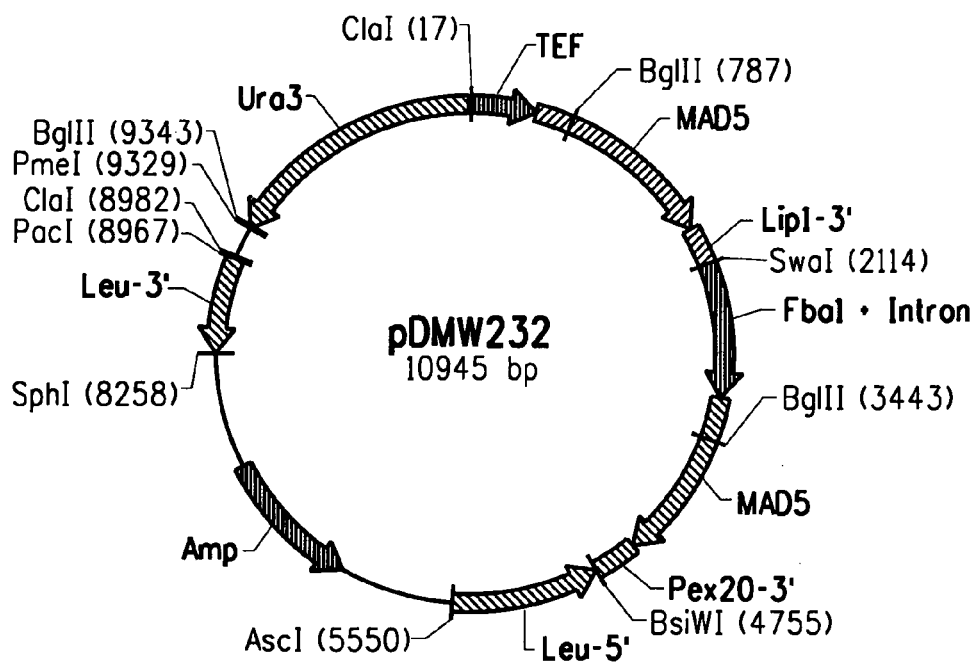

Construct pDMW232 (FIG. 9B; SEQ ID NO:129) was generated to integrate two Δ5 chimeric genes into the Leu2 gene of *Yarrowia* strain M4. Plasmid pDMW232 contained the following components, as described in Table 17:

TABLE 17

Description of Plasmid pDMW232 (SEQ ID NO: 129)

| RE Sites And Nucleotides Within SEQ ID NO: 129 | Description Of Fragment And Chimeric Gene Components |
|---|---|
| AscI/BsiWI (5550-4755) | 788 bp 5' part of *Yarrowia* Leu2 gene (GenBank Accession No. AF260230) |
| SphI/PacI (8258-8967) | 703 bp 3' part of *Yarrowia* Leu2 gene (GenBank Accession No. AF260230) |
| SwaI/BsiWI (2114-4755) | FBAIN::MAΔ5::Pex20, comprising: FBAIN: FBAIN promoter (SEQ ID NO: 177) MAΔ5: *Mortierella alpina* Δ5 desaturase gene (SEQ ID NO: 6) (GenBank Accession No. AF067654) Pex20: Pex20 terminator sequence of *Yarrowia* Pex20 gene (GenBank Accession No. AF054613) |
| SwaI/ClaI (2114-17) | TEF::MAΔ5::Lip1, comprising: TEF: TEF promoter (GenBank Accession No. AF054508) MAΔ5: SEQ ID NO: 6 (*supra*) Lip1: Lip1 terminator sequence of *Yarrowia* Lip1 gene (GenBank Accession No. Z50020) |
| PmeI/ClaI (5550-4755) | *Yarrowia* Ura3 gene (GenBank Accession No. AJ306421) |

Plasmid pDMW232 was digested with AscI/SphI, and then used to transform strain M4 according to the General Methods. Following transformation, the cells were plated onto MMLe plates and maintained at 30° C. for 2 to 3 days. The individual colonies grown on MMLe plates from each transformation were picked and streaked onto MM and MMLe plates.

Those colonies that could grow on MMLe plates but not on MM plates were selected as Leu2⁻ strains. Single colonies of Leu2⁻ strains were then inoculated into liquid MMLe media at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of ARA in pDMW232 transformants, but not in the parental M4 strain. Specifically, among the 48 selected Leu2⁻ transformants with pDMW232, there were 34 strains that produced less than 5% ARA, 11 strains that produced 6-8% ARA, and 3 strains that produced about 10% ARA of total lipids in the engineered *Yarrowia*. One of the strains that produced 10% ARA was named "Y2034".

Generation of E Strain to Produce About 10% EPA of Total Lipids

Figure 9C:
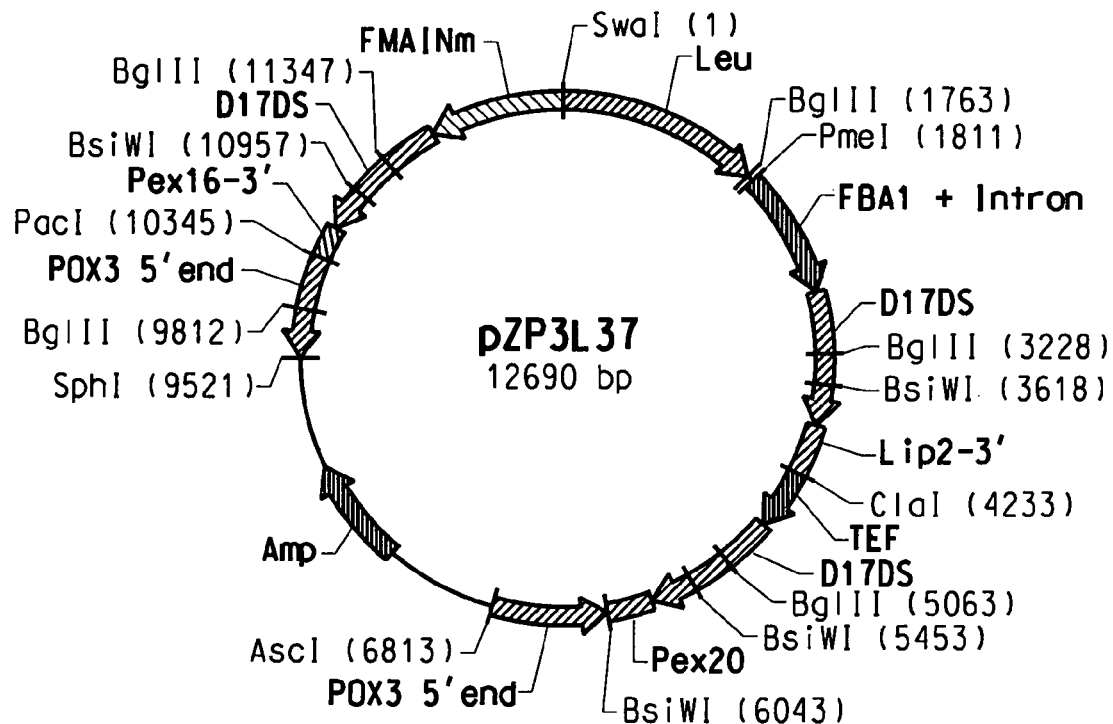

Construct pZP3L37 (FIG. 9C; SEQ ID NO:130) was created to integrate three synthetic Δ17 desaturase chimeric genes into the acyl-CoA oxidase 3 gene of the Y2034 strain. The plasmid pZP3L37 contained the following components:

TABLE 18

Description of Plasmid pZP3L37 (SEQ ID NO: 130)

| RE Sites And Nucleotides Within SEQ ID NO: 130 | Description Of Fragment And Chimeric Gene Components |
|---|---|
| AscI/BsiWI (6813-6043) | 763 bp 5' part of *Yarrowia* Pox3 gene (GenBank Accession No. AJ001301) |
| SphI/PacI (9521-10345) | 818 bp 3' part of *Yarrowia* Pox3 gene (GenBank Accession No. AJ001301) |
| ClaI/BsiWI (4233-6043) | TEF::Δ17S::Pex20, comprising: TEF: TEF promoter (GenBank Accession No. AF054508) Δ17S: codon-optimized Δ17 desaturase gene (SEQ ID NO: 16), derived from *S. diclina* (US 2003/0196217 A1) Pex20: Pex20 terminator sequence of *Yarrowia* Pex20 gene (GenBank Accession No. AF054613) |
| ClaI/PmeI (4233-1811) | FBAIN::Δ17S::Lip2, comprising: FBAIN: FBAIN promoter (SEQ ID NO: 177) Δ17S: SEQ ID NO: 16 (*supra*) Lip2: Lip2 terminator sequence of *Yarrowia* Lip2 gene (GenBank Accession No. AJ012632) |
| PmeI/SwaI (1811-1) | *Yarrowia* Leu2 gene (GenBank Accession No. AF260230) |
| PacI/SwaI (10345-1) | FBAINm::Δ17S::Pex16, comprising: FBAINm: FBAINm promoter (SEQ ID NO: 178) Δ17S: SEQ ID NO: 16 (*supra*) Pex16: Pex16 terminator sequence of *Yarrowia* Pex16 gene (GenBank Accession No. U75433) |

Plasmid pZP3L37 was digested with AscI/SphI, and then used to transform strain Y2034 according to the General Methods. Following transformation, the cells were plated onto MM plates and maintained at 30° C. for 2 to 3 days. A total of 48 transformants grown on the MM plates were picked and re-streaked onto fresh MM plates. Once grown, these strains were individually inoculated into liquid MM at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in most of the transformants with pZP3L37, but not in the parental strain (i.e., Y2034). Among the 48 selected transformants with pZP3L37, there were 18 strains that produced less than 2% EPA, 14 strains that produced 2-3% EPA, and 1 strain that produced about 7% EPA of total lipids in the engineered *Yarrowia*.

The strain that produced 7% EPA was further analyzed after culturing the strain using "two-stage growth conditions", as described in the General Methods (i.e., 48 hrs MM, 72 hrs HGM). GC analyses showed that the engineered strain produced about 10% EPA of total lipids after the two-stage growth. The strain was designated as the "E" strain.

Generation of EU Strain to Produce About 10% EPA of Total Lipids With Ura− Phenotype Strain EU (Ura⁻) was created by identifying mutant cells of strain E that were 5-FOA resistant. Specifically, one loop of *Yarrowia* E strain cells were inoculated into 3 mL YPD medium and grown at 30° C. with shaking at 250 rpm for 24 hrs. The culture was diluted with YPD to an OD$_{600}$ of 0.4 and then incubated for an additional 4 hrs. The culture was plated (100 µl/plate) onto MM+FOA plates and maintained at 30° C. for 2 to 3 days. A total of 16 FOA resistant colonies were picked and streaked onto MM and MM+FOA selection plates. From these, 10 colonies grew on FOA selection plates but not on MM plates and were selected as potential Ura⁻ strains.

Figure 9D:
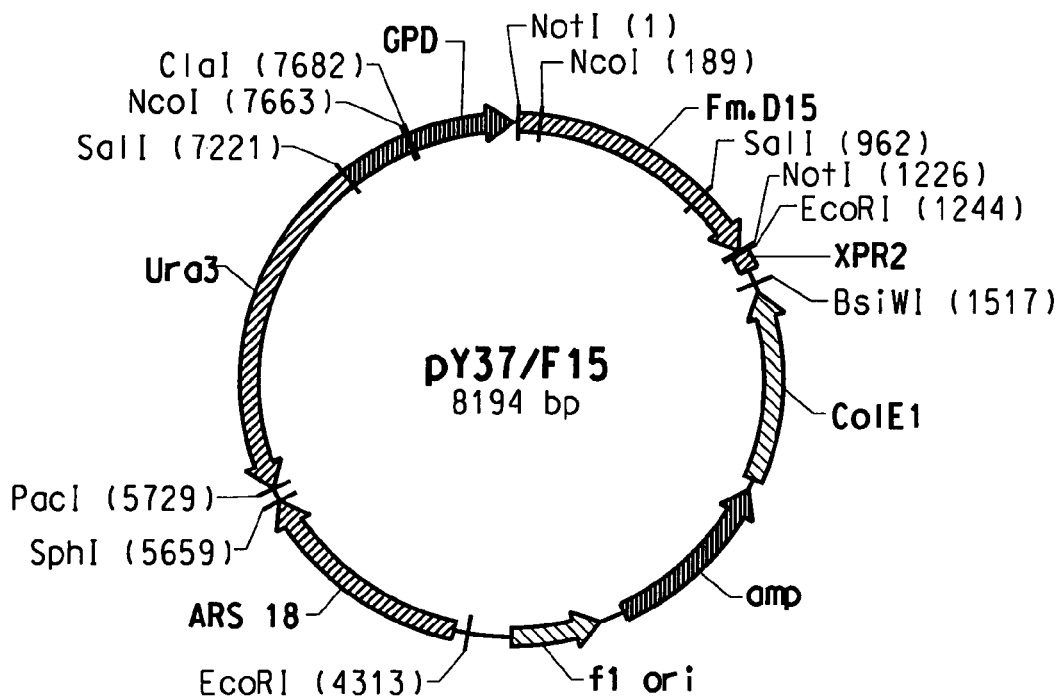

One of these strains was used as host for transformation with pY37/F15, comprising a chimeric GPD::*Fusarium moniliforme* Δ15::XPR2 gene and a Ura3 gene as a selection marker (FIG. 9D; SEQ ID NO:131). After three days of selection on MM plates, hundreds of colonies had grown on the plates and there was no colony growth of the transformation control that carried no plasmid. This 5-FOA resistant strain was designated as strain "EU".

Single colonies of the EU strain were then inoculated into liquid MMU additionally containing 0.1 g/L uridine and cultured for 2 days at 30° C. with shaking at 250 rpm/min. The cells were collected by centrifugation, lipids were extracted, and fatty acid methyl esters were prepared by trans-esterification and subsequently analyzed with a Hewlett-Packard 6890 GC. GC analyses showed that the EU strain produced about 10% EPA of total lipids.

Generation of Y2067 Strain to Produce About 15% EPA of Total Lipids

Figure 9E:
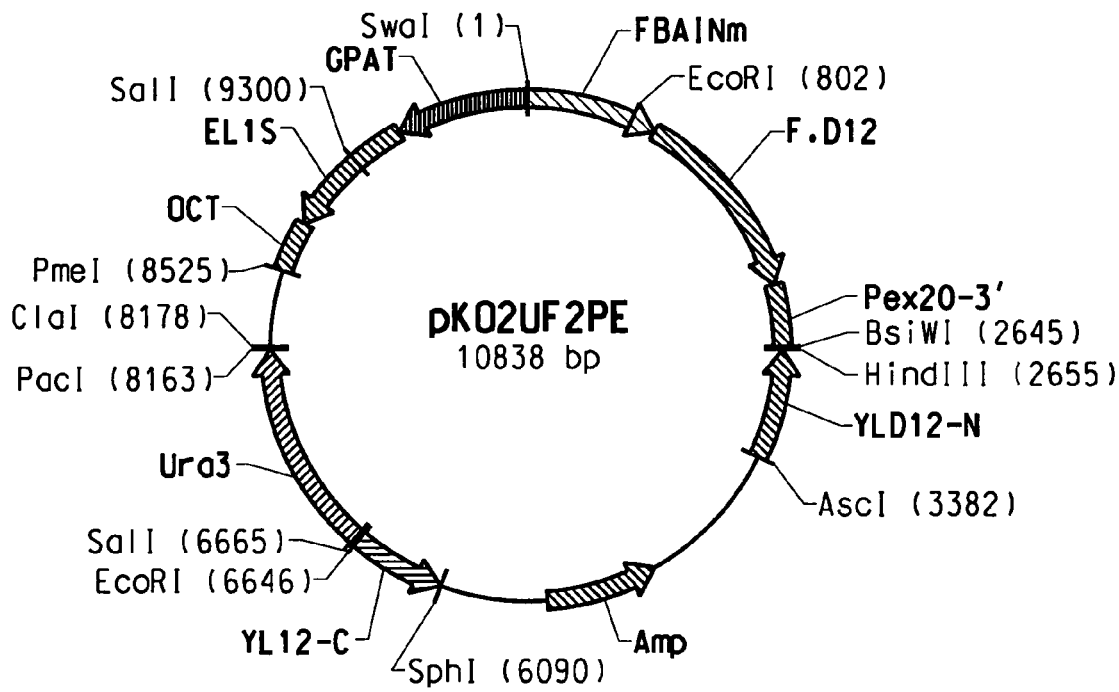

Plasmid pKO2UF2PE (FIG. 9E; SEQ ID NO:132) was created to integrate a cluster containing two chimeric genes (comprising a heterologous Δ12 desaturase and a $C_{18/20}$ elongase) and a Ura3 gene into the native Yarrowia Δ12 desaturase gene of strain EU. Plasmid pKO2UF2PE contained the following components:

TABLE 19

Description of Plasmid pKO2UF2PE (SEQ ID NO: 132)

| RE Sites And Nucleotides Within SEQ ID NO: 132 | Description Of Fragment And Chimeric Gene Components |
|---|---|
| AscI/BsiWI (3382-2645) | 730 bp 5' part of Yarrowia Δ12 desaturase gene (SEQ ID NO: 23) |
| SphI/EcoRI (6090-6646) | 556 bp 3' part of Yarrowia Δ12 desaturase gene (SEQ ID NO: 23) |
| SwaI/BsiWI/ (1-2645) | FBAINm::F.Δ12DS::Pex20, comprising: FBAINm: FBAINm promoter (SEQ ID NO: 178) F.Δ12: Fusarium moniliforme Δ12 desaturase gene (SEQ ID NO: 27) Pex20: Pex20 terminator sequence of Yarrowia Pex20 gene (GenBank Accession No. AF054613) |
| SwaI/PmeI (1-8525) | GPAT::EL1S::OCT, comprising: GPAT: GPAT promoter (SEQ ID NO: 179) EL1S: codon-optimized elongase 1 gene (SEQ ID NO: 19), derived from Mortierella alpina (GenBank Accession No. AX464731) OCT: OCT terminator sequence of Yarrowia OCT gene (GenBank Accession No. X69988) |
| EcoRI/PacI (6646-8163) | Yarrowia Ura3 gene (GenBank Accession No. AJ306421) |

Plasmid pKO2UF2PE was digested with AscI/SphI and then used to transform strain EU according to the General Methods (although strain EU was streaked onto a YPD plate and grown for approximately 36 hr prior to suspension in transformation buffer [versus 18 hrs]). Following transformation, cells were plated onto MM plates and maintained at 30° C. for 2 to 3 days. A total of 72 transformants grown on MM plates were picked and re-streaked separately onto fresh MM plates. Once grown, these strains were individually inoculated into liquid MM at 30° C. and shaken at 250 rpm/min for 2 days. The cells were collected by centrifugation, lipids were extracted, and fatty acid methyl esters were prepared by transesterification, and subsequently analyzed with a Hewlett-Packard 6890 GC.

GC analyses showed the presence of EPA in almost all of the transformants with pKO2UF2PE. More specifically, among the 72 selected transformants, there were 17 strains that produced 8-9.9% EPA, 27 strains that produced 10-10.9% EPA, 16 strains that produced 11-11.9% EPA, and 7 strains that produced 12-12.7% EPA of total lipids in the engineered Yarrowia. The strain that produced 12.7% EPA was further analyzed by using two-stage growth conditions, as described in the General Methods (i.e., 48 hrs MM, 72 hrs HGM). GC analyses showed that the engineered strain produced about 15% EPA of total lipids after the two-stage growth. The strain was designated as strain "Y2067".

Figure 10A:
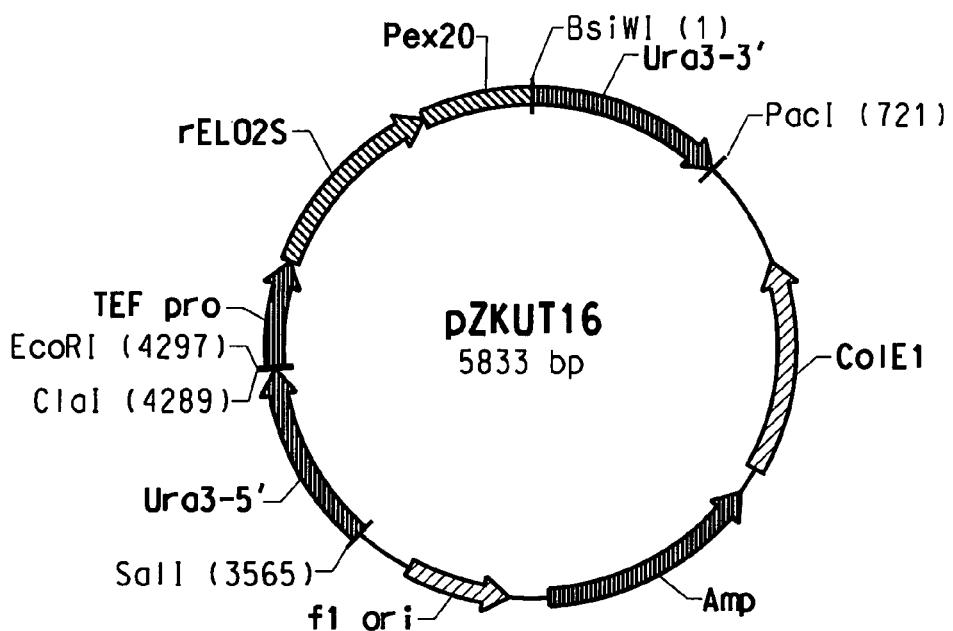

Generation of Y2067U Strain to Produce About 14% EPA of Total Lipids with Ura– Phenotype In order to disrupt the Ura3 gene in Y2067 strain, construct pZKUT16 (FIG. 10A; SEQ ID NO:133) was created to integrate a TEF::rELO2S::Pex20 chimeric gene into the Ura3 gene of strain Y2067. rELO2S is a codon-optimized rELO gene encoding a rat hepatic enzyme that elongates 16:0 to 18:0 (i.e., a $C_{16/18}$ elongase). The plasmid pZKUT16 contained the following components:

TABLE 20

Description of Plasmid pZKUT16 (SEQ ID NO: 133)

| RE Sites And Nucleotides Within SEQ ID NO: 133 | Description Of Fragment And Chimeric Gene Components |
|---|---|
| BsiWI/PacI (1-721) | 721 bp 5' part of Yarrowia Ura3 gene (GenBank Accession No. AJ306421) |
| SalI/ClaI (3565-4289) | 724 bp 3' part of Yarrowia Ura3 gene (GenBank Accession No. AJ306421) |
| ClaI/BsiWI (4289-1) | TEF::rELO2S::Pex20, comprising: TEF: TEF promoter (GenBank Accession No. AF054508) rELO2S: codon-optimized rELO2 elongase gene (SEQ ID NO: 65), derived from rat (GenBank Accession No. AB071986) Pex20: Pex20 terminator sequence of Yarrowia Pex20 gene (GenBank Accession No. AF054613) |

The plasmid pZKUT16 was digested with SalI/PacI, and then used to transform Y2067 strain according to the General Methods. Following transformation, cells were plated onto MM+5-FOA selection plates and maintained at 30° C. for 2 to 3 days.

A total of 24 transformants grown on MM+5-FOA plates were picked and re-streaked onto MM plates and MM+5-FOA plates, separately. The strains that could grow on MM+5-FOA plates, but not on MM plates, were selected as Ura– strains. A total of 10 Ura– strains were individually inoculated into liquid MMU media at 30° C. and grown with shaking at 250 rpm/min for 1 day. The cells were collected by centrifugation, lipids were extracted, and fatty acid methyl esters were prepared by trans-esterification, and subsequently analyzed with a Hewlett-Packard 6890 GC.

GC analyses showed the presence of 5 to 7% EPA in all of the transformants with pZKUT16 after one day growth in MMU media. The strain that produced 6.2% EPA was further analyzed using the two-stage growth conditions (i.e., 48 hrs MM, 96 hrs HGM). GC analyses showed that the engineered strain produced about 14% EPA of total lipids. The strain was designated as strain "Y2067U".

The final genotype of this strain with respect to wildtype Yarrowia lipolytica ATCC #20362 was as follows: Ura3-, Pox3-, Y.Δ12-, FBA::F.Δ12::Lip2, FBAINm::F. Δ12::Pex20, TEF::Δ6S::Lip1, FBAIN::E1S::Pex20, GPA T::E1 S::Oct, TEF::E2S::Xpr, FBAIN::Δ5::Pex20, TEF::Δ5::Lip1, FBAIN::Δ17S::Lip2, FBAINm::Δ17S::Pex16, TEF::Δ17S and TEF::rELO2S::Pex20.

Example 5

The ω-6 Δ6 Desaturase/Δ6 Elongase Pathway: Generation of Y2102 Strain to Produce About 18% EPA of Total Lipids The present Example describes the construction of strain Y2102, derived from Yarrowia lipolytica ATCC #20362, capable of producing 18% EPA relative to the total lipids (FIG. 5). This strain was engineered to express the ω-6 Δ6 desaturase/Δ6 elongase pathway.

The development of strain Y2102 required the construction of strain M4 (producing 8% DGLA and described in Example 4), strain Y2034 (producing 10% ARA and described in Example 4), strain E (producing 10% EPA and described in Example 4), strain EU (producing 10% EPA and described in Example 4), strain Y2065 (producing 14% EPA) and strain Y2065U (producing 13% EPA).

Generation of Y2065 Strain to Produce About 14% EPA of Total Lipids

Figure 10B:
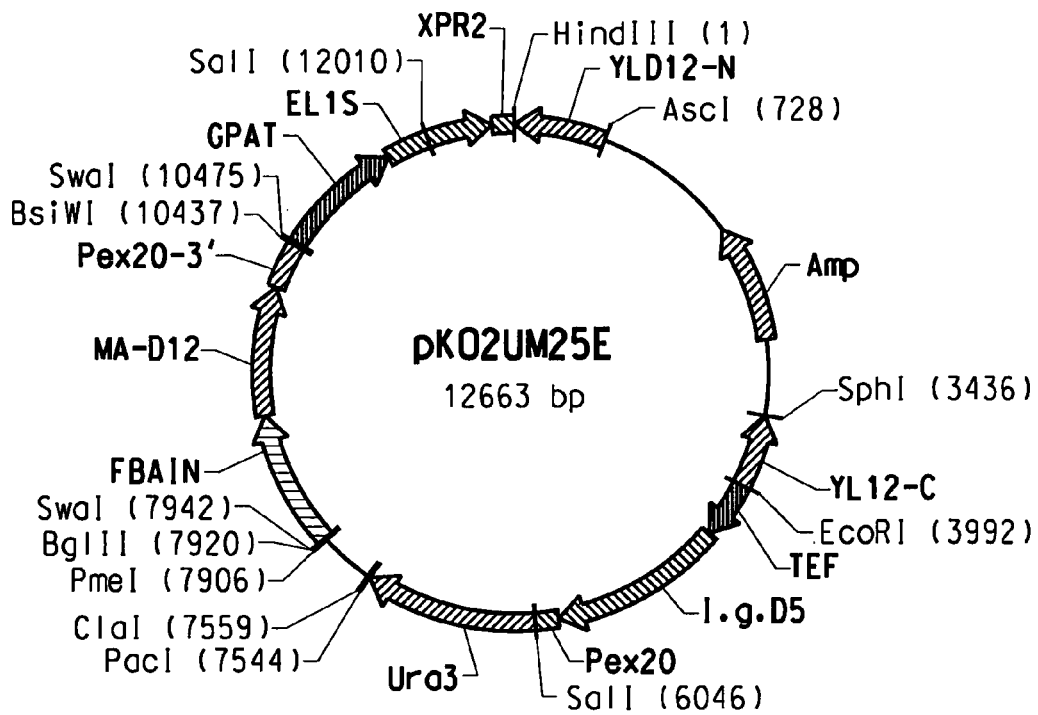

Construct pKO2UM25E (FIG. 10B; SEQ ID NO:134) was created to integrate a cluster of three chimeric genes (comprising a $C_{18/20}$ elongase, a Δ12 desaturase and a Δ5 desaturase) and a Ura3 gene into the native Yarrowia Δ12 desaturase gene of strain EU (Example 4). Plasmid pKO2UM25E contained the following components:

TABLE 21

Description of Plasmid pKO2UM25E (SEQ ID NO: 134)

| RE Sites And Nucleotides Within SEQ ID NO: 134 | Description Of Fragment And Chimeric Gene Components |
|---|---|
| HindIII/AscI (1-728) | 728 bp 5' part of Yarrowia Δ12 desaturase gene (SEQ ID NO: 23) |
| SphI/EcoRI (3436-3992) | 556 bp 3' part of Yarrowia Δ12 desaturase gene (SEQ ID NO: 23) |
| BsiWI/HindIII (10437-1) | GPAT::EL1S::XPR, comprising:<br>GPAT: GPAT promoter (SEQ ID NO: 179)<br>EL1S: codon-optimized elongase 1 gene (SEQ ID NO: 19), derived from Mortierella alpina (GenBank Accession No. AX464731)<br>XPR: ~100 bp of the 3' region of the Yarrowia Xpr gene (GenBank Accession No. M17741) |
| BglII/BsiWI (7920-10437) | FBAIN::M.Δ12::Pex20, comprising:<br>FBAIN: FBAIN promoter (SEQ ID NO: 177)<br>M.Δ12: Mortierella isabellina Δ12 desaturase gene (GenBank Accession No. AF417245; SEQ ID NO: 25)<br>Pex20: Pex20 terminator sequence of Yarrowia Pex20 gene (GenBank Accession No. AF054613) |
| SalI/PacI (6046-7544) | Yarrowia Ura3 gene (Gene Bank Accession No. AJ306421) |
| EcoRI/SalI (3992-6046) | TEF::I.Δ5S::Pex20, comprising:<br>TEF: TEF promoter (GenBank Accession No. AF054508)<br>I.Δ5S: codon-optimized Δ5 desaturase gene (SEQ ID NO: 10), derived from Isochrysis galbana (WO 2002/081668)<br>Pex20: Pex20 terminator sequence of Yarrowia Pex20 gene (GenBank Accession No. AF054613) |

The plasmid pKO2UM25E was digested with SphI/AscI, and then used to transform EU strain (Example 4) according to the General Methods. Following transformation, cells were plated onto MM plates and maintained at 30° C. for 2 to 3 days.

A total of 48 transformants grown on MM plates were picked and re-streaked onto fresh MM plates. Once grown, these strains were individually inoculated into liquid MM at 30° C. and grown with shaking at 250 rpm/min for 1 day. The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants with pKO2UM25E after one-day growth in MM media. Among the 48 selected transformants, 8 strains produced less than 4% EPA, 12 strains produced 4-5% EPA, and 24 strains produced 5-6% EPA of total lipids in the engineered Yarrowia. The strain that produced 5.7% EPA was selected for further analysis using the two-stage growth procedure (i.e., 48 hrs MM, 96 hrs HGM). GC analyses showed that the engineered strain produced about 14.3% EPA of total lipids. The strain was designated as strain "Y2065".

Generation of Y2065U Strain to Produce About 13% EPA of Total Lipids With Ura– Phenotype The construct pZKUT16 (FIG. 10A, Example 4) was used to integrate a TEF::rELO2S::Pex20 chimeric gene into the Ura3 gene of Y2065 strain. Thus, plasmid pZKUT16 was digested with SalI/PacI and then used to transform strain Y2065 according to the General Methods. Following transformation, cells were plated onto MM+5-FOA selection plates and maintained at 30° C. for 2 to 3 days.

A total of 48 transformants grown on MM+5-FOA plates were picked and re-streaked onto MM plates and MM+5-FOA plates, separately. Those strains that could grow on MM+5-FOA plates, but not on MM plates, were selected as Ura– strains. These Ura– strains (48 in total) were individually inoculated into liquid MMU at 30° C. and grown with shaking at 250 rpm/min for 1 day. The cells were collected by centrifugation, lipids were extracted, and fatty acid methyl esters were prepared by trans-esterification, and subsequently analyzed with a Hewlett-Packard 6890 GC.

GC analyses showed that there were 13 strains that produced 5-6.9% EPA and 11 strains that produced 7-8% EPA of total lipids after one day growth in MMU media. Strain #11 that had produced 7.3% EPA was further analyzed using two-stage growth conditions (i.e., 48 hrs MM, 96 hrs HGM). GC analyses showed that the engineered strain produced about 13.1% EPA of total lipids. The strain was designated as strain "Y2065U".

Generation of Y2102 Strain to Produce About 18% EPA of Total Lipids

Figure 10C:
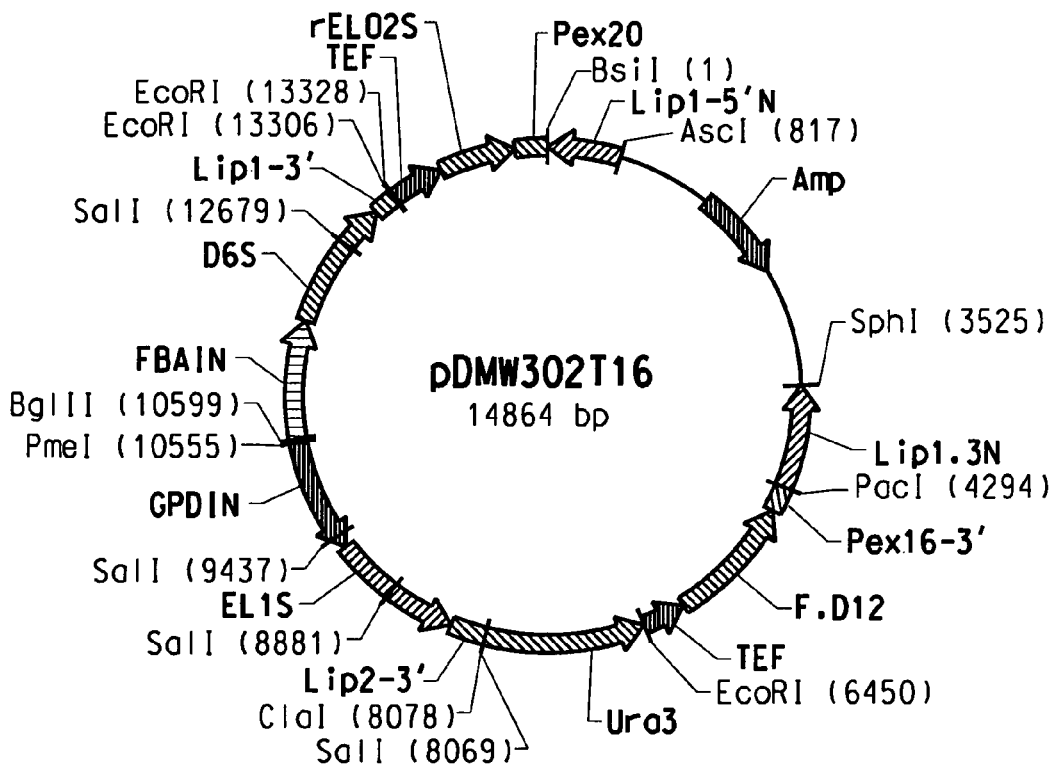

Construct pDMW302T16 (FIG. 10C; SEQ ID NO:135) was created to integrate a cluster of four chimeric genes (comprising a $C_{16/18}$ elongase, a $C_{18/20}$ elongase, a Δ6 desaturase and a Δ12 desaturase) and a Ura3 gene into the Yarrowia lipase1 gene site of Y2065U strain. Plasmid pDMW302T16 contained the following components:

TABLE 22

Description of Plasmid pDMW302T16 (SEQ ID NO: 135)

| RE Sites And Nucleotides Within SEQ ID NO: 135 | Description Of Fragment And Chimeric Gene Components |
|---|---|
| BsiWI/AscI (1-817) | 817 bp 5' part of Yarrowia lipase1 gene (GenBank Accession No. Z50020) |
| SphI/PacI 3525-4294 | 769 bp 3' part of Yarrowia lipase1 gene (GenBank Accession No. Z50020) |
| EcoRI/BsiWI (13328-1) | TEF::rELO2S::Pex20, comprising:<br>TEF: TEF promoter (GenBank Accession No. AF054508)<br>rELO2S: codon-optimized rELO2 elongase gene (SEQ ID NO: 65), derived from rat (GenBank Accession No. AB071986)<br>Pex20: Pex20 terminator sequence of Yarrowia Pex20 gene (GenBank Accession No. AF054613) |
| BglII/EcoRI (10599-13306) | FBAIN::D6S::Lip1, comprising:<br>FBAIN: FBAIN promoter (SEQ ID NO: 177)<br>Δ6S: codon-optimized Δ6 desaturase gene (SEQ ID NO: 3), derived from Mortierella alpina (GenBank Accession No. AF465281)<br>Lip 1: Lip1 terminator sequence from Yarrowia Lip1 gene (GenBank Accession No. Z50020) |

TABLE 22-continued

Description of Plasmid pDMW302T16 (SEQ ID NO: 135)

| RE Sites And Nucleotides Within SEQ ID NO: 135 | Description Of Fragment And Chimeric Gene Components |
|---|---|
| ClaI/PmeI (8078-10555) | GPDIN::EL1S::Lip2, comprising:<br>GPDIN: GPDIN promoter (SEQ ID NO: 174)<br>EL1S: codon-optimized elongase 1 gene (SEQ ID NO: 19), derived from *Mortierella alpina* (GenBank Accession No. AX464731)<br>Lip2: Lip2 terminator of *Yarrowia* lipase2 gene (GenBank Accession No. AJ012632) |
| EcoRI/ClaI (6450-8078) | *Yarrowia* Ura 3 gene (Gene Bank Accession No. AJ306421) |
| PacI/EcoRI (4294-6450) | TEF:: F.Δ12::Pex16, comprising:<br>TEF: TEF promoter (GenBank Accession No. AF054508)<br>F.Δ12: *Fusarium moniliforme* Δ12 desaturase gene (SEQ ID NO: 27)<br>Pex16: Pex16 terminator of *Yarrowia* Pex16 gene (GenBank Accession No. U75433) |

The plasmid pDMW302T16 was digested with SphI/AscI, and then used to transform Y2065U strain according to the General Methods. Following transformation, cells were plated onto MM plates and maintained at 30° C. for 2 to 3 days. A total of 48 transformants grown on MM plates were picked and re-streaked onto fresh MM plates. Once grown, these strains were individually inoculated into liquid MM at 30° C. and grown with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in almost all transformants of Y2065U with pDMW302T16 after two-day growth in MM media. Among the 48 selected transformants, there were 12 strains that produced less than 10% EPA, 22 strains that produced 10-12.9% EPA, 12 strains that produced 13-15% EPA, and one strain (i.e., #29) that produced 15.8% EPA of total lipids in the engineered *Yarrowia*. Strain #29 was selected for further analysis using the two-stage growth procedure (i.e., 48 hrs MM, 96 hrs in HGM). GC analyses showed that the engineered strain produced about 18.3% EPA of total lipids. Strain #29 was designated as strain "Y2102". The final genotype of this strain with respect to wildtype *Yarrowia lipolytica* ATCC #20362 was as follows: Pox3-, LIP1-, Y.Δ12-, FBA::F.Δ12::Lip2, TEF::F. Δ12::Pex16, FBAIN::MD12::Pex20, TEF::Δ6S::Lip 1, FBAIN::D6S::Lip 1, FBAIN::E1S::Pex20, GPAT::E1S::Oct, GPDIN::E1S::Lip2, TEF::E2S::Xpr, FBAIN::MAΔ5::Pex20, TEF::MAΔ5::Lip1, TEF::ID5S::Pex20, FBAIN::Δ17S::Lip2, FBAINm::Δ17S::Pex16, TEF::Δ17S and 2×TEF::rELO2S::Pex20.

Example 6

The ω-6 Δ6 Desaturase/Δ6 Elongase Pathway: Generation of Y2088 Strain to Produce About 20% EPA of Total Lipids The present Example describes the construction of strain Y2088, derived from *Yarrowia lipolytica* ATCC #20362, capable of producing 20% EPA relative to the total lipids (FIG. 5). This strain was engineered to express the ω-6 Δ6 desaturase/Δ6 elongase pathway.

The development of strain Y2088 required the construction of strain M4 (producing 8% DGLA and described in Example 4), strain Y2034 (producing 10% ARA and described in Example 4), strain E (producing 10% EPA and described in Example 4), strain EU (producing 10% EPA and described in Example 4), strain Y2065 (producing 14% EPA and described in Example 5) and strain Y2065U (producing 13% EPA and described in Example 5).

Generation of Y2088 Strain to Produce About 20% EPA of Total Lipids

Figure 10D:
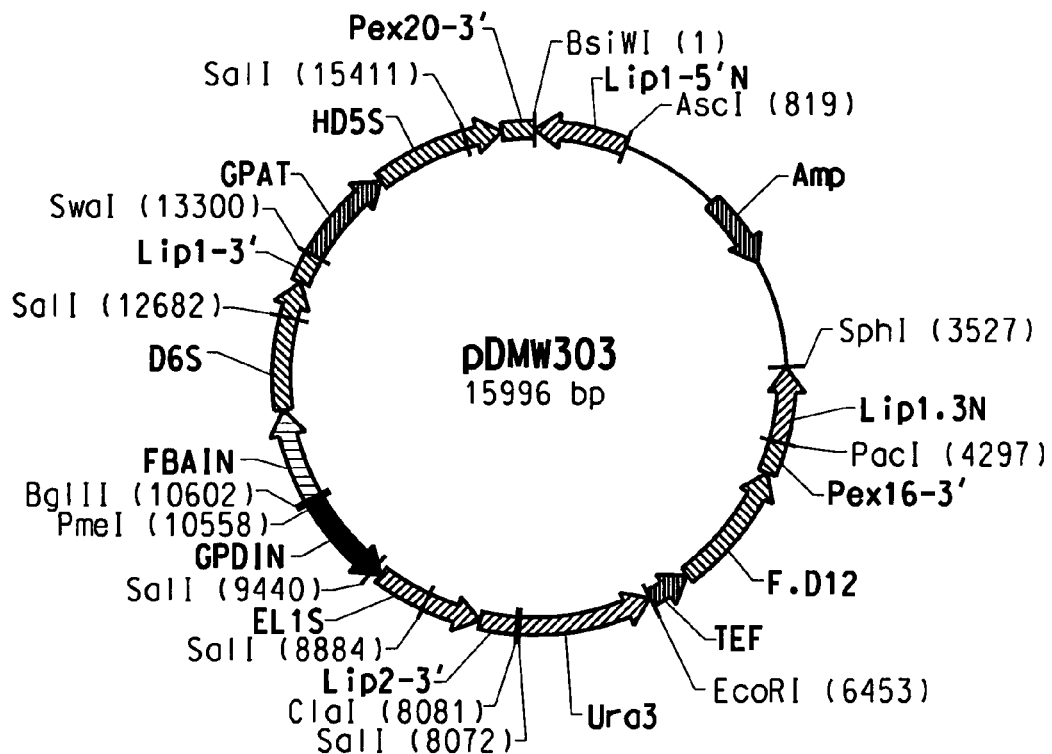

Construct pDMW303 (FIG. 10D; SEQ ID NO:136) was created to integrate a cluster of four chimeric genes (comprising a $C_{18/20}$ elongase, a Δ6 desaturase, a Δ5 desaturase and a Δ12 desaturase) and a Ura3 gene into the *Yarrowia* lipase1 gene site of Y2065U strain (Example 5). Plasmid pDMW303 contained the following components:

TABLE 23

Description of Plasmid pDMW303 (SEQ ID NO: 136)

| RE Sites And Nucleotides Within SEQ ID NO: 136 | Description Of Fragment And Chimeric Gene Components |
|---|---|
| BsiWI/AscI (1-819) | 819 bp 5' part of *Yarrowia* lipase1 gene (GenBank Accession No. Z50020) |
| SphI/PacI (35278-4297) | 769 bp 3' part of *Yarrowia* lipase1 gene (GenBank Accession No. Z50020) |
| SwaI/BsiWI (13300-1) | GPAT::HΔ5S::Pex20, comprising:<br>GPAT: GPAT promoter (SEQ ID NO: 179)<br>HΔ5S: codon-optimized Δ5 desaturase gene (SEQ ID NO: 13), derived from *Homo sapiens* (GenBank Accession No. NP_037534)<br>Pex20: Pex20 terminator sequence of *Yarrowia* Pex20 gene (GenBank Accession No. AF054613) |
| BglII/SwaI (10602-13300) | FBAIN::D6S::Lip1, comprising:<br>FBAIN: FBAIN promoter (SEQ ID NO: 177)<br>Δ6S: codon-optimized Δ6 desaturase gene (SEQ ID NO: 3), derived from *Mortierella alpina* (GenBank Accession No. AF465281)<br>Lip1: Lip1 terminator sequence from *Yarrowia* Lip1 gene (GenBank Accession No. Z50020) |
| ClaI/PmeI (8081-10558) | GPDIN::EL1S::Lip2, comprising:<br>GPDIN: GPDIN promoter (SEQ ID NO: 174)<br>EL1S: codon-optimized elongase 1 gene (SEQ ID NO: 19), derived from *Mortierella alpina* (GenBank Accession No. AX464731)<br>Lip2: Lip2 terminator of *Yarrowia* lipase2 gene (GenBank Accession No. AJ012632) |
| EcoRI/ClaI (6453-8081) | *Yarrowia* Ura 3 gene (GenBank Accession No. AJ306421) |
| PacI/EcoRI (4297-6453) | TEF:: F.Δ12::Pex16, comprising:<br>TEF: TEF promoter (GenBank Accession No. AF054508)<br>F.Δ12: *Fusarium moniliforme* Δ12 desaturase gene (SEQ ID NO: 27)<br>Pex16: Pex16 terminator of *Yarrowia* Pex16 gene (GenBank Accession No. U75433) |

Plasmid pDMW303 was digested with SphI/AscI, and then used to transform strain Y2065U (Example 5) according to the General Methods. Following transformation, cells were plated onto MM plates and maintained at 30° C. for 2 to 3 days.

A total of 48 transformants grown on MM plates were picked and re-streaked onto fresh MM plates. Once grown, these strains were individually cultured using the two-stage growth procedure (i.e., 48 hrs MM, 96 hrs HGM). The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants with pDMW303 after two-stage growth.

Among the 48 selected transformants, there were 25 strains that produced 11.6-14.9% EPA, 17 strains that produced 15-17.9% EPA, 2 strains that produced 18-18.7% EPA, and one strain (i.e., #38) that produced about 20% EPA of total lipids. Strain #38 was designated as strain "Y2088". The final genotype of this strain with respect to wildtype *Yarrowia lipolytica* ATCC #20362 was as follows: Pox3-, Lip1-, Y.Δ12-, FBA::F.Δ12::Lip2, TEF::F. Δ12::Pex16, FBAIN:: MΔ12::Pex20, TEF::Δ6S::Lip 1, FBAIN::D6S::Lip 1, FBAIN::EIS::Pex20, GPA T::EIS::Oct, GPDIN::E1S::LipZ TEF::E2S::Xpr, FBAIN::MAΔ5::Pex20, TEF::MAΔ5::Lip1, TEF::ID5S::Pex20, GPT::HD5S::Lip 1, FBAIN::Δ 7S::Lip2, FBAINm::Δ17S::Pex16, TEF::Δ 7S and TEF::rELO2S:: Pex20.

Example 7

The ω-6 Δ6 Desaturase/Δ6 Elongase Pathway: Generation of Y2089 Strain to Produce About 18% EPA of Total Lipids The present Example describes the construction of strain Y2089, derived from *Yarrowia lipolytica* ATCC #20362, capable of producing 18% EPA relative to the total lipids (FIG. 5). This strain was engineered to express the ω-6 Δ6 desaturase/Δ6 elongase pathway.

The development of strain Y2089 required the construction of strain M4 (producing 8% DGLA and described in Example 4), strain Y2047 (producing 11% ARA), strain Y2048 (producing 11% EPA), strain Y2060 (producing 13% EPA), strain Y2072 (producing 15% EPA) and strain Y2072U1 (producing 14% EPA).

Generation of Y2047 Strain to Produce About 10% ARA of Total Lipids

Figure 10E:
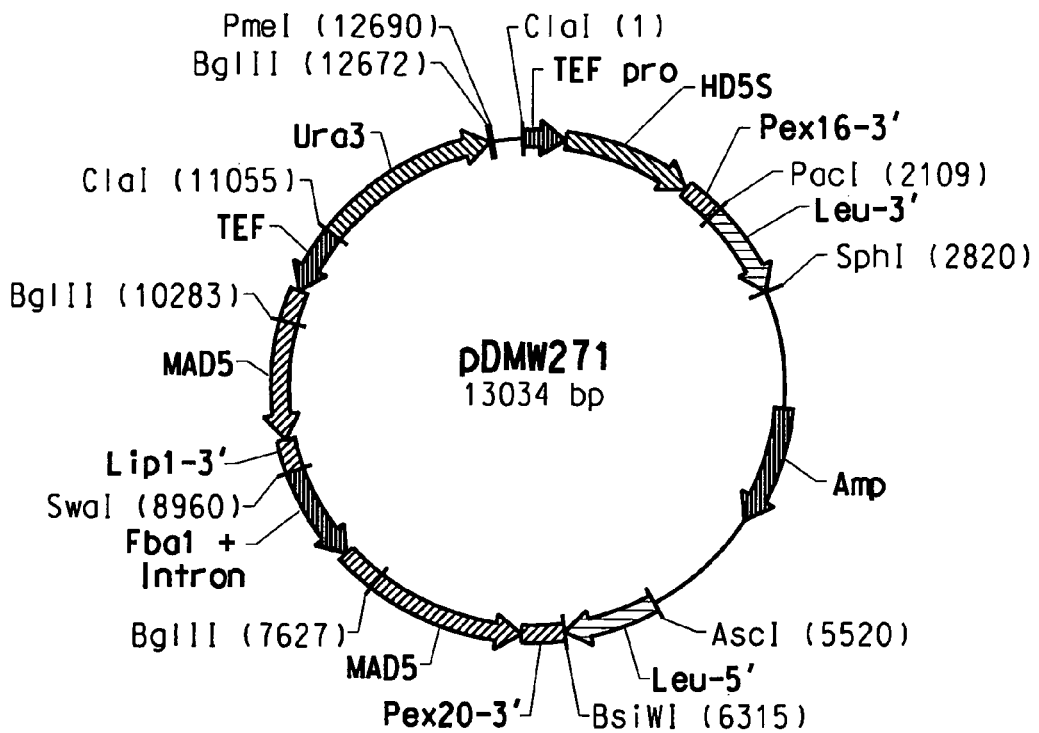

Construct pDMW271 (FIG. 10E; SEQ ID NO:137) was generated to integrate three Δ5 chimeric genes into the Leu2 gene of *Yarrowia* strain M4 (Example 4). Plasmid pDMW271 contained the following components, as described in Table 24:

TABLE 24

Description of Plasmid pDMW271 (SEQ ID NO: 137)

| RE Sites And Nucleotides Within SEQ ID NO: 137 | Description Of Fragment And Chimeric Gene Components |
|---|---|
| AscI/BsiWI (5520-6315) | 788 bp 5' part of *Yarrowia* Leu2 gene (GenBank Accession No. AF260230) |
| SphI/PacI (2820-2109) | 703 bp 3' part of *Yarrowia* Leu2 gene (GenBank Accession No. AF260230) |
| SwaI/BsiWI (8960-6315) | FBAIN::MAΔ5::Pex20, comprising: FBAIN: FBAIN promoter (SEQ ID NO: 177) MAΔ5: *Mortierella alpina* Δ5 desaturase gene (SEQ ID NO: 6) (GenBank Accession No. AF067654) Pex20: Pex20 terminator sequence of *Yarrowia* Pex20 gene (GenBank Accession No. AF054613) |
| SwaI/ClaI (8960-11055) | TEF::MAΔ5::Lip1, comprising: TEF: TEF promoter (GenBank Accession No. AF054508) MAΔ5: SEQ ID NO: 6 (*supra*) Lip1: Lip1 terminator sequence of *Yarrowia* Lip1 gene (GenBank Accession No. Z50020) |
| PmeI/ClaI (12690-11055) | *Yarrowia* Ura3 gene (GenBank Accession No. AJ306421) |
| ClaI/PacI (1-2109) | TEF::HΔ5S::Pex16, comprising: TEF: TEF promoter (GenBank Accession No. AF054508) HΔ5S: codon-optimized Δ5 desaturase gene (SEQ ID NO: 13), derived from *Homo sapiens* (GenBank Accession No. NP_037534) Pex16: Pex16 terminator sequence of *Yarrowia* Pex16 gene (GenBank Accession No. U75433) |

Plasmid pDMW271 was digested with AscI/SphI, and then used to transform strain M4 according to the General Methods. Following transformation, the cells were plated onto MMLe plates and maintained at 30° C. for 2 to 3 days. The individual colonies grown on MMLe plates were picked and streaked onto MM and MMLe plates. Those colonies that could grow on MMLe plates but not on MM plates were selected as Leu2⁻ strains. Single colonies of Leu2⁻ strains were then inoculated into liquid MMLe media at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of ARA in pDMW271 transformants, but not in the parental M4 strain. Specifically, among the 48 selected Leu2⁻ transformants with pDMW271, there were 35 strains that produced less than 5% ARA of total lipids, 12 strains that produced 6-8% ARA, and 1 strain that produced about 11% ARA of total lipids in the engineered *Yarrowia*. The strain that produced 11% ARA was named "Y2047".

Generation of Y2048 Strain to Produce About 11% EPA of Total Lipids

Plasmid pZP3L37 (Example 4) was digested with AscI/SphI, and then used to transform strain Y2047 according to General Methods. Following transformation, the cells were plated onto MM plates and maintained at 30° C. for 2 to 3 days. A total of 96 transformants grown on the MM plates were picked and re-streaked onto fresh MM plates. Once grown, these strains were individually inoculated into liquid MM at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in most of the transformants with pZP3L37, but not in the parental Y2047 strain. Among the 96 selected transformants with pZP3L37, there were 20 strains that produced less than 2% EPA, 23 strains that produced 2-3% EPA, 5 strains that produced 3-4% EPA, and 2 strains (i.e., strain #71 and strain #94) that produced about 6% EPA of total lipids in the engineered *Yarrowia*. Strain #71 (which produced 6% EPA) was further analyzed by culturing it in two-stage growth conditions (i.e., 48 hrs MM, 72 hrs HMG). GC analyses showed that strain #71 produced about 11% EPA of total lipids. The strain was designated as "Y2048".

Generation of Y2060 Strain to Produce About 13% EPA of Total Lipids With Ura− Phenotype The construct pZKUT16 (FIG. 10A, SEQ ID NO:133; see Example 4) was used to integrate a TEF::rELO2S::Pex20 chimeric gene into the Ura3 gene of Y2048 strain. Specifically, plasmid pZKUT16 was digested with SalI/PacI, and then used to transform strain Y2048 according to the General Methods. Following transformation, cells were plated onto MM+5-FOA selection plates and maintained at 30° C. for 2 to 3 days.

A total of 40 transformants grown on MM+5-FOA plates were picked and re-streaked onto MM plates and MM+5-FOA plates, separately. Those strains that could grow on MM+5-FOA plates, but not on MM plates, were selected as Ura− strains. Each of these 40 Ura− strains were individually inoculated into liquid MMU and grown at 30° C. with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that there were 14 strains that produced less than 5% EPA, 9 strains that produced 5-5.9% EPA, 15 strains that produced 6-6.9% EPA, and 7 strains that produced 7-8% EPA of total lipids after two day growth in MMU media. The strains that produced 7-8% EPA were further analyzed using two-stage growth conditions (i.e., 48 hrs MM, 96 hrs HGM). GC analyses showed that all these strains produced more than 10% EPA; and, one of them produced about 13% EPA of the total lipids. That strain was designated as strain "Y2060".

Generation of Y2072 Strain to Produce About 15% EPA of Total Lipids

Construct pKO2UM25E (FIG. 10B; SEQ ID NO:134; see Example 5) was used to integrate a cluster of three chimeric genes (comprising a $C_{18/20}$ elongase, a Δ12 desaturase and a Δ5 desaturase) and a Ura3 gene into the native Yarrowia Δ12 desaturase gene site of strain Y2060. Specifically, plasmid pKO2UM25E was digested with SphI/AscI, and then used to transform Y2060 according to the General Methods. Following transformation, cells were plated onto MM plates and maintained at 30° C. for 2 to 3 days.

A total of 63 transformants grown on MM plates were picked and re-streaked onto fresh MM plates. Once grown, these strains were individually inoculated into liquid MM at 30° C. and cultured with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in almost all transformants with pKO2UM25E after one-day growth in MM media. Among the 63 selected transformants, there were 26 strains that produced 6-8.9% EPA and 46 strains that produced more than 9% EPA. The strains that produced more than 9% EPA were selected for further analysis using two-stage growth conditions (i.e., 48 hrs MM, 96 hrs HGM). GC analyses showed that 45 out of the 46 selected strains produced 11-14.5% EPA while culture #2 produced 15.1% EPA of total lipids after the two-stage growth. This strain (i.e., #2) was designated as strain "Y2072".

Figure 11A:
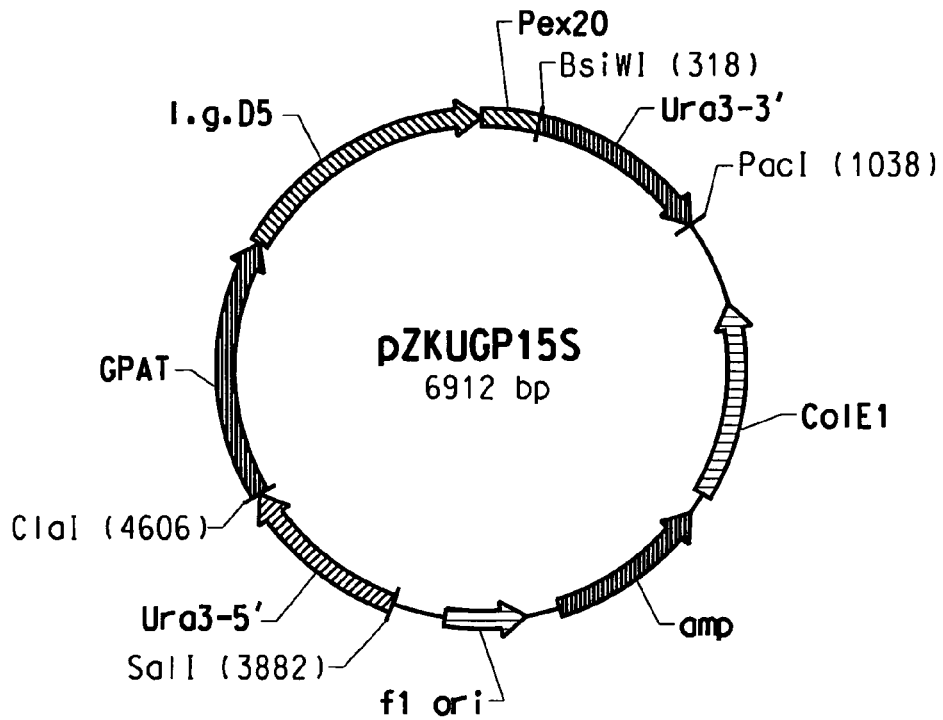
Figure 11B:
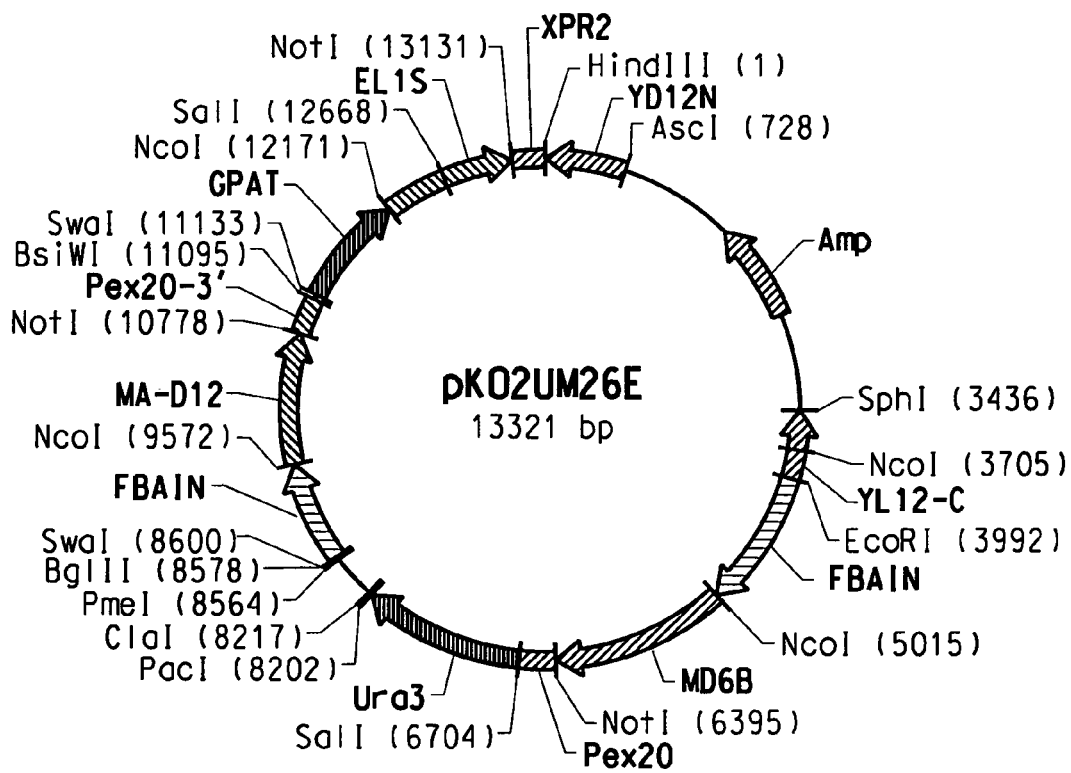
Figure 11C:
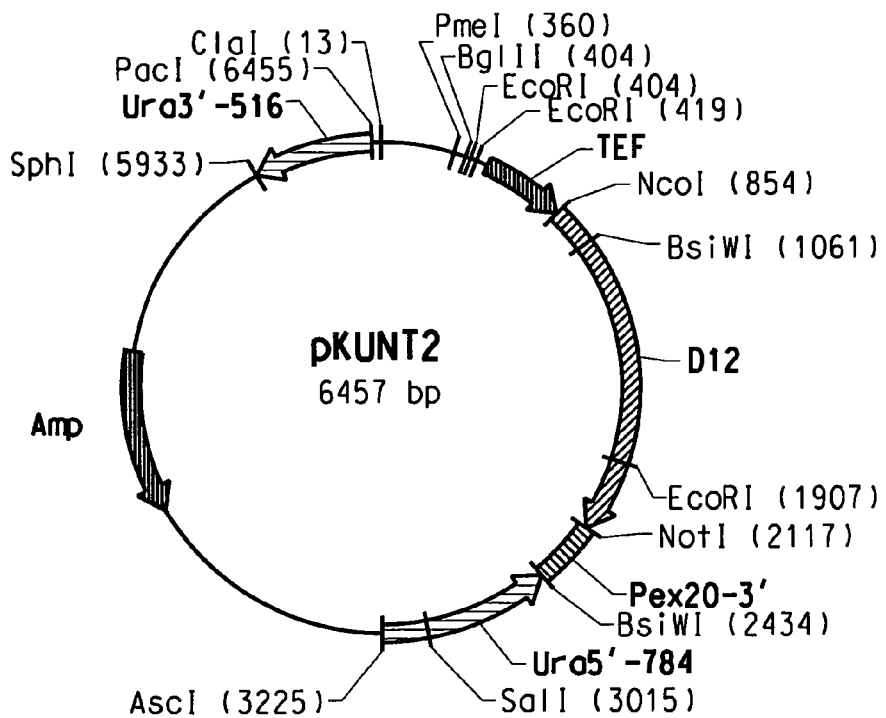

Generation of Y2072U1 and Y2072U2 Strains to Produce About 14% EPA of Total Lipids with Ura− Phenotype The construct pZKUGPI5S (FIG. 11A; SEQ ID NO:138) was created to integrate a GPAT::I.Δ5S::Pex20 chimeric gene into the Ura3 gene of Y2072 strain. More specifically, plasmid pZKUGPI5S contained the following components:

TABLE 25

Description of Plasmid pZKUGPI5S (SEQ ID NO: 138)

| RE Sites And Nucleotides Within SEQ ID NO: 138 | Description Of Fragment And Chimeric Gene Components |
|---|---|
| BsiWI/PacI (318-1038) | 721 bp 5' part of Yarrowia Ura3 gene (GenBank Accession No. AJ306421) |

TABLE 25-continued

Description of Plasmid pZKUGPI5S (SEQ ID NO: 138)

| RE Sites And Nucleotides Within SEQ ID NO: 138 | Description Of Fragment And Chimeric Gene Components |
|---|---|
| SalI/ClaI (3882-4606) | 724 bp 3' part of Yarrowia Ura3 gene (GenBank Accession No. AJ306421) |
| ClaI/BsiWI (4606-318) | GPAT::I.Δ5S::Pex20, comprising: GPAT: GPAT promoter (SEQ ID NO: 179) I.Δ5S: codon-optimized Δ5 desaturase gene (SEQ ID NO: 10), derived from Isochrysis galbana (WO 2002/081668) Pex20: Pex20 terminator sequence of Yarrowia Pex20 gene (GenBank Accession No. AF054613) |

Plasmid pZKUGPI5S was digested with SalI/PacI, and then used to transform strain Y2072 according to the General Methods. Following transformation, cells were plated onto MM+5-FOA selection plates and maintained at 30° C. for 3 to 4 days.

A total of 24 transformants grown on MM+5-FOA plates were picked and re-streaked onto MM plates and MM+5-FOA plates, separately. Those strains that could grow on MM+5-FOA plates, but not on MM plates, were selected as Ura− strains. Each of these 24 Ura− strains were individually inoculated into liquid MMU and grown at 30° C. with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that there were 8 strains that produced 7.3-8.9% EPA, 14 strains that produced 9-9.9% EPA, 1 strain that produced 10.5% EPA (i.e., #1) and 1 strain that produced 10.7% EPA (i.e., #23) of total lipids after two day growth in MMU. Strains #1 and #23 were further analyzed using the two-stage growth conditions (i.e., 48 hrs MM, 96 hrs HGM). GC analyses showed that these two strains produced about 14% EPA of total lipids after the two-stage growth. Strain #1 was designated as strain "Y2072U1" and strain #23 was designated as "Y2072U2".

Generation of Y2089 Strain to Produce About 18% EPA of Total Lipids

Construct pDMW302T16 (FIG. 10C, SEQ ID NO:135; see Example 5) was used to integrate a cluster of four chimeric genes (comprising a $C_{16/18}$ elongase, a $C_{18/20}$ elongase, a Δ6 desaturase and a Δ12 desaturase) and a Ura3 gene into the Yarrowia lipase1 gene site of Y2072U1 strain. Plasmid pDMW302T16 was digested with SphI/AscI, and then used to transform strain Y2072U1 according to the General Methods. Following transformation, cells were plated onto MM plates and maintained at 30° C. for 3 to 4 days.

A total of 48 transformants grown on MM plates were picked and re-streaked onto fresh MM plates. Once grown, these strains were individually inoculated into liquid MM and grown at 30° C. with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants of Y2072U1 with pDMW302T16 after two-day growth in MM media. Among the 48 selected transformants, there were 27 strains that produced less than 10% EPA, 14 strains that produced 10-12.9% EPA and 5 strains that produced 13-13.9% EPA. Strain #34 (producing 13.9%

EPA) was selected for further analysis using the two-stage growth procedure (i.e., 48 hrs MM, 96 hrs HGM). GC analyses showed that strain #34 produced about 18% EPA of total lipids. Strain #34 was designated as strain "Y2089". The final genotype of this strain with respect to wildtype *Yarrowia lipolytica* ATCC #20362 was as follows: Pox3-, LIP1-, Y.Δ12-, FBA::F.Δ12::Lip2, TEF::F. Δ12::Pex16, FBAIN:: MΔ12::Pex20, TEF::Δ6S::Lip1, FBAIN::Δ6S::Lip1, FBAIN::E1S::Pex20, GPAT::E1S::Oct, GPDIN::E1S::Lip2, TEF::E2S::Xpr, FBAIN::MAΔ5::Pex20, TEF::MAΔ5::Lip1, TEF::HΔ5S::Pex16, TEF::IΔ5S::Pex20, GPAT::IΔ5S::Pex20, FBAIN::Δ17S::Lip2, FBAINm::Δ17S::Pex16, TEF::Δ17S:: Pex16 and 2X TEF::rELO2S::Pex20.

Example 8

The ω-6 Δ6 Desaturase/Δ6 Elongase Pathway: Generation of Y2095 Strain to Produce About 19% EPA of Total Lipids The present Example describes the construction of strain Y2095, derived from *Yarrowia lipolytica* ATCC #20362, capable of producing 19% EPA relative to the total lipids (FIG. 5). This strain was engineered to express the ω-6 Δ6 desaturase/Δ6 elongase pathway.

The development of strain Y2095 required the construction of strain M4 (producing 8% DGLA and described in Example 4), strain Y2047 (producing 11% ARA and described in Example 7), strain Y2048 (producing 11% EPA and described in Example 7), strain Y2060 (producing 13% EPA and described in Example 7), strain Y2072 (producing 15% EPA and described in Example 7) and strain Y2072U1 (producing 14% EPA and described in Example 7).
Generation Of Y2095 Strain to Produce About 19% EPA Of Total Lipids Construct pDMW303 (FIG. 10D, SEQ ID NO:136; see Example 6) was also used to integrate a cluster of four chimeric genes (comprising a $C_{18/20}$ elongase, a Δ6 desaturase, a Δ5 desaturase and a Δ12 desaturase) and a Ura3 gene into the *Yarrowia* lipase1 gene site of strain Y2072U1 (Example 7). SphI/AscI-digested plasmid was transformed into strain Y2072U1 according to the General Methods. Following transformation, cells were plated onto MM plates and maintained at 30° C. for 3 to 4 days.

A total of 48 transformants grown on MM plates were picked and re-streaked onto fresh MM plates. Once grown, these strains were individually inoculated into liquid MM and grown at 30° C. with shaking at 250 rpm/min for 2 days. The cells were collected by centrifugation, resuspended in HGM, and grown for 5 days at 30° C. with shaking at 250 rpm/min. After the two-stage growth, the cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants of Y2072U1 with pDMW303 after two-stage growth. Among the 48 selected transformants, there were 37 strains that produced less than 15% EPA, 8 strains that produced 15-16% EPA, and one strain (i.e., #28) that produced 19% EPA. Strain #28 was designated as strain "Y2095".

The final genotype of this strain with respect to wildtype *Yarrowia lipolytica* ATCC #20362 was as follows: Pox3-, LIP1-, Y.Δ12-, FBA::F.Δ12::Lip2, TEF::F.Δ12::Pex16, FBAIN::MΔ12::Pex20, TEF::Δ6S::Lip 1, FBAIN::Δ6S::Lip 1, FBAIN::E1S::Pex20, GPAT::E1S::Oct, GPDIN::E1S:: Lip2, TEF::E2S::Xpr, FBAIN::MAΔ5::Pex20, TEF:: MAΔ5::Lip1, TEF::HΔ5S::Pex16, GPAT::HD5S::Pex20, TEF::IΔ5S::Pex20, GPAT::IΔ5S::Pex20, FBAIN::Δ17S:: Lip2, FBAINm::Δ17S::Pex16, TEF::Δ17S::Pex16 and TEF:: rELO2S::Pex20.

Example 9

The ω-6 Δ6 Desaturase/Δ6 Elongase Pathway: Generation of Strain Y2107U1, Producing 16% EPA of Total Lipids The present Example describes the construction of strain Y2107U1, derived from *Yarrowia lipolytica* ATCC #20362, capable of producing 16% EPA relative to the total lipids (FIG. 5). This strain was engineered to express the ω-6 Δ6 desaturase/Δ6 elongase pathway. The affect of *M. alpina* GPAT gene over-expression was examined in this EPA producing strain based on analysis of TAG content and/or composition, as described in Example 23 (infra).

The development of strain Y2107U1 required the construction of strain M4 (producing 8% DGLA and described in Example 4), strain Y2047 (producing 11% ARA and described in Example 7), strain Y2048 (producing 11% EPA and described in Example 7), strain Y2060 (producing 13% EPA and described in Example 7), strain Y2072 (producing 15% EPA and described in Example 7), strain Y2072U1 (producing 14% EPA and described in Example 7) and Y2089 (producing 18% EPA and described in Example 7).
Generation of Y2107U1 Strain to Produce About 16% EPA of Total Lipids with Ura– Phenotype Construct pZKUGPE1S (SEQ ID NO:139) was created to integrate a GPAT::EL1S::Pex20 chimeric gene into the Ura3 gene of strain Y2089. More specifically, plasmid pZKUGPE1S contained the following components:

TABLE 26

Description of Plasmid pZKUGPE1S (SEQ ID NO: 139)

| RE Sites And Nucleotides Within SEQ ID NO: 139 | Description Of Fragment And Chimeric Gene Components |
|---|---|
| BsiWI/PacI (318-1038) | 721 bp 5' part of *Yarrowia* Ura3 gene (GenBank Accession No. AJ306421) |
| SalI/ClaI (3882-4606) | 724 bp 3' part of *Yarrowia* Ura3 gene (GenBank Accession No. AJ306421) |
| ClaI/BsiWI (4606-318) | GPAT::E1S::Pex20, comprising:<br>GPAT: GPAT promoter (SEQ ID NO: 179)<br>EL1S: codon-optimized elongase 1 gene (SEQ ID NO: 19), derived from *Mortierella alpina* (GenBank Accession No. AX464731)<br>Pex20: Pex20 terminator sequence of *Yarrowia* Pex20 gene (GenBank Accession No. AF054613) |

Plasmid pZKUGPE1 S was digested with PstI/PacI, and then used to transform strain Y2089 according to the General Methods. Following transformation, cells were plated onto MM+5-FOA selection plates and maintained at 30° C. for 3 to 4 days.

A total of 8 transformants grown on MM+5-FOA plates were picked and re-streaked onto MM plates and MM+5-FOA plates, separately. Those strains that could grow on MM+5-FOA plates, but not on MM plates, were selected as Ura– strains. Each of these 8 Ura– strains were individually inoculated into liquid MMU and grown at 30° C. with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that there were 6 strains that produced 6.6-8.7% EPA and 2 strains that produced 9.4-10% EPA (i.e., #4 and #5) of total lipids after two day growth in MMU. Strains #4 and #5 were further analyzed using the two-stage growth conditions (i.e., 48 hrs MM, 96 hrs HGM). GC analyses showed that these two strains produced about 16% EPA of total lipids after the two-stage growth. Strain #4 was designated as strain "Y2107U1" and strain #5 was designated as strain "Y2107U2".

Example 10

The ω-6 Δ6 Desaturase/Δ6 Elongase Pathway: Generation of Y2090 Strain to Produce About 26% EPA of Total Lipids The present Example describes the construction of strain Y2090, derived from *Yarrowia lipolytica* ATCC #20362, capable of producing 26% EPA relative to the total lipids (FIG. 5). This strain was engineered to express the ω-6 Δ6 desaturase/Δ6 elongase pathway.

The development of strain Y2090 required the construction of strain M4 (producing 8% DGLA and described in Example 4), strain Y2047 (producing 11% ARA and described in Example 7), strain Y2048 (producing 11% EPA and described in Example 7), strain Y2060 (producing 13% EPA and described in Example 7), strain Y2072 (producing 15% EPA and described in Example 7) and strain Y2072U3 (producing 16% EPA).

Generation of Y2072U3 and Y2072U4 Strains to Produce About 15-16% EPA of Total Lipids with Ura− Phenotype The construct pZKUT16 (FIG. 10A, SEQ ID NO:133; see Example 4) was used to integrate a TEF::rELO2S::Pex20 chimeric gene into the Ura3 gene of strain Y2072 (Example 7). Specifically, SalI/PacI-digested plasmid pZKUT16 was used to transform strain Y2072 according to the General Methods. Following transformation, cells were plated onto MM+5-FOA selection plates and maintained at 30° C. for 3 to 4 days.

A total of 24 transformants grown on MM+5-FOA plates were picked and re-streaked onto MM plates and MM+5-FOA plates, separately. The strains that could grow on MM+5-FOA plates, but not on MM plates, were selected as Ura− strains. These 24 Ura− strains were individually inoculated into liquid MMU at 30° C. and cultured with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that there were 14 strains that produced less than 8.9% EPA, 8 strains that produced 9-9.9% EPA, and 1 strain (i.e., #12) that produced 10.1% EPA of total lipids after two day growth in MMU media. Strains #12 (10.1% EPA) and #11 (9.6% EPA) were further analyzed using the two-stage growth procedure (i.e., 48 hrs MM, 96 hrs HGM). GC analyses showed that strain #12 produced about 15% EPA and this strain was designated as strain "Y2072U3". In contrast, strain #11 produced about 16% EPA and this strain was designated as strain "Y2072U4".

Generation of Y2090, Y2091 and Y2092 Strains to Produce More Than 20% EPA of Total Lipids Construct pDMW302T16 (FIG. 10C, SEQ ID NO:135; see Example 5) was also used to integrate a cluster of four chimeric genes (comprising a $C_{16/18}$ elongase, a $C_{18/20}$ elongase, a Δ6 desaturase and a Δ12 desaturase) and a Ura3 gene into the *Yarrowia* lipase1 gene site of strain Y2072U3. Specifically, plasmid pDMW302T16 was digested with SphI/AscI, and then used to transform strain Y2072U3 according to the General Methods. Following transformation, cells were plated onto MM plates and maintained at 30° C. for 2 to 3 days.

A total of 48 transformants grown on MM plates were picked and re-streaked onto fresh MM plates. Once grown, these strains were individually inoculated into liquid MM and grown at 30° C. with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants of Y2072U3 with pDMW302T16 after two days growth in MM. Among the 48 selected transformants, there were 9 strains that produced less than 10% EPA, 26 strains that produced 10-11.9% EPA, 12 strains that produced 12-13% EPA, and one strain (i.e., #9) that produced 15.8% EPA.

Strains #9 (producing 15.8% EPA), #20 (producing 12.6% EPA) and #21 (producing 12.2% EPA) were selected for further analysis by two-stage growth procedure (i.e., 48 hrs MM, 96 hrs HGM). GC analyses showed that strain #20 strain (subsequently designated as strain "Y2090") produced about 21% EPA, strain #9 (subsequently designated as strain "Y2091") produced about 19% EPA and strain #21 (subsequently designated as strain "Y2092") produced about 20% EPA of total lipids.

The EPA and total oil content in strain Y2090 was further analyzed using a modified two-stage growth procedure as follows. Strain Y2090 was grown from a single colony in 3 mL SD+AA media at 30° C. with shaking at 250 rpm/min. After 24 hrs of growth, the 3 mL starter culture was added to an Erlenmeyer flask containing 32 mL of SD+AA media. After 48 hrs of additional growth at 30° C. and shaking at 250 rpm/min, the cells were pelleted and the supernatents were removed. The pellets were re-suspended in 35 mL HGM in a 250 mL flask. The 35 mL culture was incubated at 30° C. and grown with shaking at 250 rpm/min for 4 additional days. After this period of incubation, the $OD_{600}$ of the Y2090 culture was 6.29. An aliquot (1 mL) of culture was used for GC analysis and 30 mL of culture was used for measurement of dry cell weight.

GC analysis was performed as described in the General Methods, except that 40 μg of C15:0 (for use as an internal control) was added into sodium methoxide for trans-esterification. Dry cell weight was determined by lyophilizing the $H_2O$-washed cell pellet from 30 mL culture. GC analyses showed that Y2090 produced about 26.6% EPA of total lipids, with about 22.8% oil/dry cell weight.

Strain Y2090 possessed the following genotype with respect to wildtype *Yarrowia lipolytica* ATCC #20362: Pox3-, LIP1-, Y.Δ12-, FBA::F.Δ12::Lip2, TEF::F.Δ2::Pex16, FBAIN::MΔ12::Pex20, TEF::Δ6S::Lip 1, FBAIN::Δ6S::Lip 1, FBAIN::E1S::Pex20, GPA T::E1S::Oct, GPDIN::E1 S::Lip2, TEF::E2S::Xpr, FBAIN::MAΔ5::Pex20, TEF::MAΔ5::Lip1, TEF::HΔ5S::Pex16, TEF:IΔ5S::Pex20, FBAIN::Δ17S::Lip2, FBAINm::Δ17S::Pex16, TEF::Δ17S::Pex16 and 3X TEF::rELO2S::Pex20.

Example 11

The ω-6 Δ6 Desaturase/Δ6 Elongase Pathway: Generation of Y2096 Strain to Produce About 28% EPA of Total Lipids The present Example describes the construction of strain Y2096, derived from *Yarrowia lipolytica* ATCC #20362, capable of producing 28% EPA relative to the total lipids (FIG. 5). This strain was engineered to express the Ω-6 Δ6 desaturase/Δ6 elongase pathway.

The development of strain Y2090 required the construction of strain M4 (producing 8% DGLA and described in Example 4), strain Y2047 (producing 11% ARA and described in Example 7), strain Y2048 (producing 11% EPA and described in Example 7), strain Y2060 (producing 13% EPA and described in Example 7), strain Y2072 (producing 15% EPA and described in Example 7) and strain Y2072U3 (producing 16% EPA and described in Example 10).

Generation of Y2096, Y2097. Y2098. Y2099. Y2105 and Y2106 Strains to Produce 23-28% EPA of Total Lipids Construct pDMW303 (FIG. 10D, SEQ ID NO:136; see Example 6) was used to integrate a cluster of four chimeric genes (comprising a $C_{18/20}$ elongase, a Δ6 desaturase, a Δ5 desaturase and a Δ12 desaturase) and a Ura3 gene into the Yarrowia lipase1 gene site of strain Y2072U3 (Example 10). Specifically, SphI/AscI-digested plasmid was transformed into strain Y2072U3 according to the General Methods. Following transformation, cells were plated onto MM plates and maintained at 30° C. for 3 to 4 days.

A total of 48 transformants grown on MM plates were picked and re-streaked onto fresh MM plates. Once grown, these strains were individually inoculated into liquid MM at 30° C. and grown with shaking at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants of Y2072U3 with pDMW303 after two days growth in MM. Among the 48 selected transformants, there were 35 strains that produced less than 13.9% EPA, 8 strains that produced 14-16.9% EPA, and 4 strains that produced 17-18.3% EPA of total lipids.

Those strains producing more than 14% EPA of total lipids (i.e., after 2 days in MM) were selected for further analysis using the two-stage growth procedure (i.e., 48 hrs MM, 96 hrs HGM). GC analyses showed that all 12 strains produced more than 18% EPA of total lipids. Among them, strain #6 (designated as strain "Y2096") produced about 24% EPA, strain #43 (designated as strain "Y2097") produced about 22.3% EPA, strain #45 (designated as strain "Y2098") produced about 22.4% EPA, strain #47 (designated as strain "Y2099") produced about 22.6% EPA, strain #5 produced about 23.3% EPA (designated as strain "Y2105") and strain #48 (designated as strain "Y2106") produced about 23% EPA of total lipids.

The EPA content and the oil amount in strain Y2096 was further analyzed following growth using the modified two-stage procedure described in Example 10. GC analyses showed that Y2096 produced about 28.1% EPA of total lipids, with about 20.8% oil/dry cell weight.

Strain Y2096 possessed the following genotype with respect to wildtype Yarrowia lipolytica ATCC #20362: POX3-, LIP1-, Y.Δ12-, FBA::F.Δ12::Lip2, TEF::F. Δ12::Pex16, FBAIN::M.Δ12::Pex20, TEF::Δ6S::Lip 1, FBAIN::Δ6S::Lip 1, FBAIN::E1S::Pex20, GPAT::E1S::Oct, GPDIN::E1S::Lip2, TEF::E2S::Xpr, FBAIN::MAΔ5::Pex20, TEF::MAΔ5::Lip 1, TEF::HΔ5S::Pex 16, TEF::IΔ5S::Pex20, GPAT::IΔ5S::Pex20, FBAIN::Δ17S::Lip2, FBAINm::Δ17S::Pex16, TEF::Δ17S::Pex16 and 2X TEF::rELO2S::Pex20.

Example 12

The ω-6 Δ6 Desaturase/Δ6 Elongase Pathway: Generation of MU Strain to Produce About 9-12% EPA of Total Lipids The present Example describes the construction of strain MU, derived from Yarrowia lipolytica ATCC #20362, capable of producing 9-12% EPA relative to the total lipids (FIG. 5). This strain was engineered to express the ω-6 Δ6 desaturase/Δ6 elongase pathway. The affect of various native Y. lipolytica acyltransferase knockouts were examined in this EPA producing strain based on analysis of TAG content and/or composition, as described in Example 30 (infra).

The development of strain MU required the construction of strain M4 (producing 8% DGLA and described in Example 4), strain Y2034 (producing 10% ARA and described in Example 4), strain E (producing 10% EPA and described in Example 4), strain EU (producing 10% EPA and described in Example 4) and strain M26 (producing 14% EPA).

Generation of M26 Strain to Produce 14% EPA of Total Lipids

Construct pZKO2UM26E (FIG. 11B, SEQ ID NO:140) was used to integrate a cluster of three chimeric genes (comprising a $C_{18/20}$ elongase, a Δ6 desaturase and a Δ12 desaturase) and a Ura3 gene into the Yarrowia Δ12 desaturase gene site of EU strain (Example 4). Plasmid pKO2UM26E contained the following components:

TABLE 27

Description of Plasmid pKO2UM26E (SEQ ID NO: 140)

| RE Sites And Nucleotides Within SEQ ID NO: 140 | Description Of Fragment And Chimeric Gene Components |
|---|---|
| HindIII/AscI (1-728) | 728 bp 5' part of Yarrowia Δ12 desaturase gene (SEQ ID NO: 23) |
| SphI/EcoRI (3436-3992) | 556 bp 3' part of Yarrowia Δ12 desaturase gene (SEQ ID NO: 23) |
| BsiWI/HindIII (11095-1) | GPAT::EL1S::XPR, comprising:<br>GPAT: GPAT promoter (SEQ ID NO: 179)<br>EL1S: codon-optimized elongase 1 gene (SEQ ID NO: 19), derived from Mortierella alpina (GenBank Accession No. AX464731)<br>XPR: ~100 bp of the 3' region of the Yarrowia Xpr gene (GenBank Accession No. M17741) |
| BglII/BsiWI (8578-11095) | FBAIN::M.Δ12::Pex20, comprising:<br>FBAIN: FBAIN promoter (SEQ ID NO: 177)<br>M.Δ12: Mortieralla isabellina Δ12 desaturase gene (GenBank Accession No. AF417245; SEQ ID NO: 25)<br>Pex20: Pex20 terminator sequence of Yarrowia Pex20 gene (GenBank Accession No. AF054613) |
| SalI/PacI (6704-8202) | Yarrowia Ura3 gene (GenBank Accession No. AJ306421) |
| EcoRI/SalI (3992-6704) | FBAIN::M.Δ6B::Pex20, comprising:<br>TEF: TEF promoter (GenBank Accession No. AF054508)<br>M.Δ6B: Mortieralla alpina Δ6 desaturase gene "B" (GenBank Accession No. AB070555; SEQ ID NO: 4)<br>Pex20: Pex20 terminator sequence of Yarrowia Pex20 gene (GenBank Accession No. AF054613) |

The plasmid pKO2UM26E was digested with SphI/AscI, and then used to transform EU strain (Example 4) according to the General Methods. Following transformation, cells were plated onto MM plates and maintained at 30° C. for 2 to 3 days.

A total of 48 transformants grown on MM plates were picked and re-streaked onto fresh MM plates. Once grown, these strains were individually inoculated into liquid MM at 30° C. and grown with shaking at 250 rpm/min for 1 day. The cells were collected by centrifugation, lipids were extracted, and fatty acid methyl esters were prepared by trans-esterification, and subsequently analyzed with a Hewlett-Packard 6890 GC.

GC analyses showed that EPA was produced in almost all transformants with pKO2UM26E after one-day growth in MM media. Among the 48 selected transformants, 5 strains produced less than 4% EPA, 23 strains produced 4-5.9% EPA, 9 strains produced 6-6.9% EPA and 11 strains produced 7-8.2% EPA of total lipids in the engineered *Yarrowia*. The strain that produced 8.2% EPA was selected for further analysis using the two-stage growth procedure (i.e., 48 hrs MM, 96 hrs HGM). GC analyses showed that the engineered strain produced about 14% EPA of total lipids. The strain was designated as strain "M26".

The final genotype of the M26 strain with respect to wild-type *Yarrowia lipolytica* ATCC #20362 was as follows: Pox3-, Y.Δ12-, FBA::F.Δ12::Lip2, FBAIN::MΔ12::Pex20, TEF::Δ6S::Lip1, FBAIN::Δ6B::Pex20, FBAIN::E1S:: Pex20, GPAT::E1S::Xpr, TEF::E2S::Xpr, FBAIN::MAΔ5:: Pex20, TEF::MAΔ5::Lip 1, TEF::HΔ5S::Pex16, FBAIN:: Δ17S::Lip2, FBAINm::Δ17S::Pex16, TEF.:Δ17S::Pex16 and TEF::rELO2S::Pex20.

Generation of MU Strain to Produce 9-12% EPA of Total Lipids

Strain MU was a Ura auxotroph of strain M26. This strain was made by transforming strain M26 with 5 μg of plasmid PZKUM (SEQ ID NO:141) that had been digested with PacI and HincII. Transformation was performed using the Frozen-EZ Yeast Transformation kit (Zymo Research Corporation, Orange, Calif.) and transformants were selected by plating 100 μl of the transformed cell mix on an agar plate with the following medium: 6.7 g/L yeast Nitrogen Base (DIFCO Laboratories, Detroit, Mich.), 20 g/L dextrose, 50 mg/L uracil and 800 mg/L FOA. After 7 days, small colonies appeared that were plated on MM and MMU agar plates. All were URA auxotrophs. One of the strains was designated "MU".

Example 13

Generation of Intermediate Strain Y2031, Having a Ura– Genotype and Producing 45% LA of Total Lipids Strain Y2031 was generated by integration of the TEF:: Y.Δ12::Pex20 chimeric gene of plasmid pKUNT2 (FIG. 11C) into the Ura3 gene locus of wild type *Yarrowia* strain ATCC #20362, to thereby to generate a Ura-genotype.

Specifically, plasmid pKUNT2 contained the following components:

TABLE 28

Description of Plasmid pKUNT2 (SEQ ID NO: 142)

| RE Sites And Nucleotides Within SEQ ID NO: 142 | Description Of Fragment And Chimeric Gene Components |
|---|---|
| AscI/BsiWI (3225-3015) | 784 bp 5' part of *Yarrowia* Ura3 gene (GenBank Accession No. AJ306421) |
| SphI/PacI (5933-13) | 516 bp 3' part of *Yarrowia* Ura3 gene (GenBank Accession No. AJ306421) |
| EcoRI/BsiWI (6380-8629) | TEF::Y.Δ12::Pex20, comprising: TEF: TEF promoter (GenBank Accession No. AF054508) Y.Δ12: *Yarrowia* Δ12 desaturase gene (SEQ ID NO: 23) |

TABLE 28-continued

Description of Plasmid pKUNT2 (SEQ ID NO: 142)

| RE Sites And Nucleotides Within SEQ ID NO: 142 | Description Of Fragment And Chimeric Gene Components |
|---|---|
| | Pex20: Pex20 terminator sequence from *Yarrowia* Pex20 gene (GenBank Accession No. AF054613) |

The pKUNT2 plasmid was digested with AscI/SphI, and then used for transformation of wild type *Y. lipolytica* ATCC #20362 according to the General Methods. The transformant cells were plated onto FOA selection media plates and maintained at 30° C. for 2 to 3 days. The FOA resistant colonies were picked and streaked onto MM and MMU selection plates. The colonies that could grow on MMU plates but not on MM plates were selected as Ura– strains. Single colonies (5) of Ura– strains were then inoculated into liquid MMU at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that there were about 45% LA in two Ura– strains (i.e., strains #2 and #3), compared to about 20% LA in the wild type ATCC #20362. Transformant strain #2 was designated as strain "Y2031".

Example 14

Synthesis and Functional Expression of A Codon-Optimized Δ9 Elongase Gene in *Yarrowia lipolytica*

The codon usage of the Δ9 elongase gene of *Isochrysis galbana* (GenBank Accession No. AF390174) was optimized for expression in *Y. lipolytica*, in a manner similar to that described in WO 2004/101753. Specifically, according to the *Yarrowia* codon usage pattern, the consensus sequence around the ATG translation initiation codon, and the general rules of RNA stability (Guhaniyogi, G. and J. Brewer, *Gene* 265(1-2):11-23 (2001)), a codon-optimized Δ9 elongase gene was designed (SEQ ID NO:51), based on the DNA sequence of the *I. galbana* gene (SEQ ID NO:49). In addition to modification of the translation initiation site, 126 bp of the 792 bp coding region were modified, and 123 codons were optimized. None of the modifications in the codon-optimized gene changed the amino acid sequence of the encoded protein (GenBank Accession No. AF390174; SEQ ID NO:50).

In Vitro Synthesis of a Codon-Optimized Δ9 Elongase Gene for *Yarrowia*

The codon-optimized Δ9 elongase gene was synthesized as follows. First, eight pairs of oligonucleotides were designed to extend the entire length of the codon-optimized coding region of the *I. galbana* Δ9 elongase gene (e.g., IL3-1A, IL3-1B, IL3-2A, IL3-2B, IL3-3A, IL3-3B, IL3-4A, IL3-4B, IL3-5A, IL3-5B, IL3-6A, IL3-6B, IL3-7A, IL3-7B, IL3-8A and IL3-8B, corresponding to SEQ ID NOs:202-217). Each pair of sense (A) and anti-sense (B) oligonucleotides were complementary, with the exception of a 4 bp overhang at each 5'-end. Additionally, primers IL3-1F, IL34R, IL3-5F and IL3-8R (SEQ ID NOs:218-221) also introduced NcoI, PstI, PstI and Not1 restriction sites, respectively, for subsequent sub-cloning.

Each oligonucleotide (100 ng) was phosphorylated at 37° C. for 1 hr in a volume of 20 μl containing 50 mM Tris-HCl (pH 7.5), 10 mM MgCl$_2$, 10 mM DTT, 0.5 mM spermidine, 0.5 mM ATP and 10 U of T4 polynucleotide kinase. Each pair of sense and antisense oligonucleotides was mixed and annealed in a thermocycler using the following parameters: 95° C. (2 min), 85° C. (2 min), 65° C. (15 min), 37° C. (15 min), 24° C. (15 min) and 4° C. (15 min). Thus, IL3-1A (SEQ ID NO:202) was annealed to IL3-1 B (SEQ ID NO:203) to produce the double-stranded product "IL3-1AB". Similarly, IL3-2A (SEQ ID NO:204) was annealed to IL3-2B (SEQ ID NO:205) to produce the double-stranded product "IL3-2AB", etc.

Two separate pools of annealed, double-stranded oligonucleotides were then ligated together, as shown below: Pool 1 (comprising IL3-1AB, IL3-2AB, IL3-3AB and IL34AB); and, Pool 2 (comprising IL3-5AB, IL3-6AB, IL3-7AB and IL3-8AB). Each pool of annealed oligonucleotides was mixed in a volume of 20 µl with 10 U of T4 DNA ligase and the ligation reaction was incubated overnight at 16° C.

The product of each ligation reaction was then used as template to amplify the designed DNA fragment by PCR. Specifically, using the ligated "Pool 1" mixture (i.e., IL3-1AB, IL3-2AB, IL3-3AB and IL3-4AB) as template, and oligonucleotides IL3-1F and IL3-4R (SEQ ID NOs:218 and 219) as primers, the first portion of the codon-optimized Δ9 elongase gene was amplified by PCR. The PCR amplification was carried out in a 50 µl total volume, as described in the General Methods. Amplification was carried out as follows: initial denaturation at 95° C. for 3 min, followed by 35 cycles of the following: 95° C. for 1 min, 56° C. for 30 sec, 72° C. for 40 sec. A final extension cycle of 72° C. for 10 min was carried out, followed by reaction termination at 4° C. The 417 bp PCR fragment was subcloned into the pGEM-T easy vector (Promega) to generate pT9(1-4).

Using the ligated "Pool 2" mixture (i.e., IL3-5AB, IL3-6AB, IL3-7AB and IL3-8AB) as the template, and oligonucleotides IL3-5F and IL3-8R (SEQ ID NOs:220 and 221) as primers, the second portion of the codon-optimized Δ9 elongase gene was amplified similarly by PCR and cloned into pGEM-T-easy vector to generate pT9(5-8).

Figure 11D:
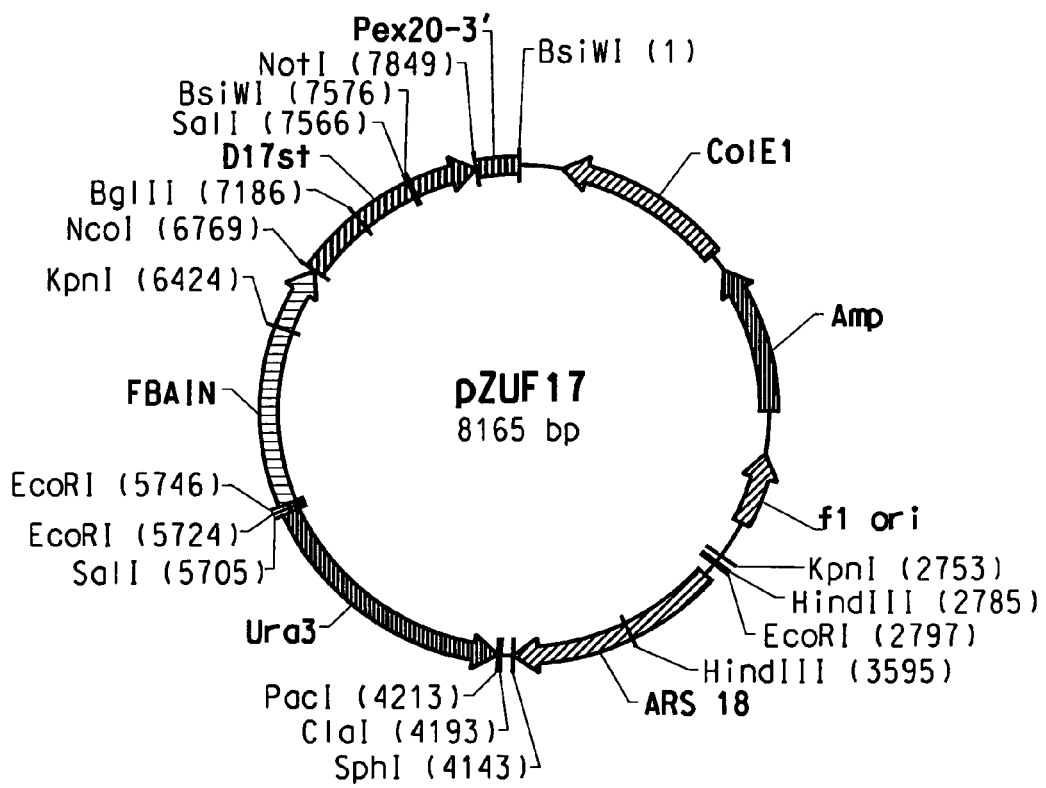

*E. coli* was transformed separately with pT9(1-4) and pT9(5-8) and the plasmid DNA was isolated from ampicillin-resistant transformants. Plasmid DNA was purified and digested with the appropriate restriction endonucleases to liberate the 417 bp NcoI/PstI fragment of pT9(1-4) (SEQ ID NO:222) and the 377 bp PstI/NotI fragment of pT9(5-8) (SEQ ID NO:223). These two fragments were then combined and directionally ligated together with NcoI/NotI digested pZUF17 (SEQ ID NO:143; FIG. 11D) to generate pDMW237 (FIG. 14A; SEQ ID NO:144). The DNA sequence of the resulting synthetic Δ9 elongase gene ("IgD9e") in pDMW237 was exactly the same as the originally designed codon-optimized gene (i.e., SEQ ID NO:51) for *Yarrowia*.

Expression of the Codon-Optimized Δ9 Elongase Gene in *Y. lipolytica*

Construct pDMW237 (FIG. 14A), an auto-replication plasmid comprising a chimeric FBAIN::Ig D9e::Pex20 gene, was transformed into *Y. lipolytica* Y2031 strain (Example 13) as described in the General Methods. Three transformants of Y2031 with pDMW237 were grown individually in MM media for two days and the cells were collected by centrifugation, lipids were extracted, and fatty acid methyl esters were prepared by trans-esterification, and subsequently analyzed with a Hewlett-Packard 6890 GC.

The GC results showed that there were about 7.1%, 7.3% and 7.4% EDA, respectively, produced in these transformants with pDMW237. These data demonstrated that the synthetic, codon-optimized IgD9e could convert C18:2 to EDA. The "percent (%) substrate conversion" of the codon-optimized gene was determined to be about 13%.

Example 15

Synthesis of a Codon-Optimized Δ8 Desaturase Gene in *Yarrowia Lipolytica*

The codon usage of the Δ8 desaturase gene of Euglena gracilis (GenBank Accession No. MD45877) was optimized for expression in *Y. lipolytica*, in a manner similar to that described in WO 2004/101753 and Example 14 (supra). Despite synthesis of three different codon-optimized genes (i.e., "D8S-1", "D8S-2" and "D8S-3"), none of the genes were capable of desaturating EDA to DGLA. It was therefore hypothesized that the previously published Δ8 desaturase sequences were incorrect and it was necessary to isolate the Δ8 desaturase from *Euglena gracilis* directly, following mRNA isolation, cDNA synthesis and PCR. This resulted in two similar sequences, identified herein as Eg5 (SEQ ID NOs:57 and 58) and Eg12 (SEQ ID NOs:59 and 60).

Functional analysis of each gene sequence was performed by cloning the genes into a *Saccharomyces cerevisiae* yeast expression vector and conducting substrate feeding trials. Although both Eg5 and Eg12 were able to desaturate EDA and ETrA to produce DGLA and ETA, respectively, Eg5 had significantly greater activity than Eg12.

Based on the confirmed Δ8 desaturase activity of Eg5, the sequence was codon-optimized for expression in *Yarrowia lipolytica* to thereby result in the synthesis of a synthetic, functional codon-optimized Δ8 desaturase designated as "D8SF" (SEQ ID NOs:61 and 62).

Preliminary In Vitro Synthesis of a Codon-Optimized Δ8 Desaturase Gene

A codon-optimized Δ8 desaturase gene (designated "D8S-1"; SEQ ID NO:55) was designed, based on the published sequence of *Euglena gracilis* (SEQ ID NOs:52 and 53), according to the *Yarrowia* codon usage pattern (WO 2004/101753), the consensus sequence around the 'ATG' translation initiation codon, and the general rules of RNA stability (Guhaniyogi, G. and J. Brewer, *Gene* 265(1-2):11-23 (2001)). In addition to modification of the translation initiation site, 200 bp of the 1260 bp coding region were modified (15.9%). None of the modifications in the codon-optimized gene changed the amino acid sequence of the encoded protein (SEQ ID NO:53) except the second amino acid from 'K' to 'E' to add a NcoI site around the translation initiation codon.

Specifically, the codon-optimized Δ8 desaturase gene was synthesized as follows. First, thirteen pairs of oligonucleotides were designed to extend the entire length of the codon-optimized coding region of the *E. gracilis* Δ8 desaturase gene (e.g., D8-1A, D8-1B, D8-2A, D8-2B, D8-3A, D8-3B, D8-4A, D8-4B, D8-5A, D8-5B, D8-6A, D8-6B, D8-7A, D8-7B, D8-8A, D8-8B, D8-9A, D8-9B, D8-10A, D8-10B, D8-11A, D8-11B, D8-12A, D8-12B, D8-13A and D8-13B, corresponding to SEQ ID NOs:224-249). Each pair of sense (A) and anti-sense (B) oligonucleotides were complementary, with the exception of a 4 bp overhang at each 5'-end. Additionally, primers D8-1A, D8-3B, D8-7A, D8-9B and D8-13B (SEQ ID NOs:224, 229, 236, 241 and 249) also introduced NcoI, BglII, XhoI, SacI and NotI restriction sites, respectively, for subsequent subcloning.

Oligonucleotides (100 ng of each) were phosphorylated as described in Example 14, and then each pair of sense and antisense oligonucleotides was mixed and annealed together [e.g., D8-1A (SEQ ID NO: 224) was annealed to D8-1B (SEQ ID NO:225) to produce the double-stranded product "D8-

1AB" and D8-2A (SEQ ID NO:226) was annealed to D8-2B (SEQ ID NO:227) to produce the double-stranded product "D8-2AB", etc.].

Four separate pools of annealed, double-stranded oligonucleotides were then ligated together, as shown below: Pool 1 (comprising D8-1AB, D8-2AB and D8-3AB); Pool 2 (comprising D8-4AB, D8-5AB and D8-6AB); Pool 3 (comprising D8-7AB, D8-8AB, and D8-9AB); and, Pool 4 (comprising D8-10AB, D8-11AB, D8-12AB and D8-13AB). Each pool of annealed oligonucleotides was mixed in a volume of 20 µl with 10 U of T4 DNA ligase and the ligation reaction was incubated overnight at 16° C.

The product of each ligation reaction was then used as template to amplify the designed DNA fragment by PCR. Specifically, using the ligated "Pool 1" mixture (i.e., D8-1AB, D8-2AB and D8-3AB) as template, and oligonucleotides D8-1F and D8-3R (SEQ ID NOs:250 and 251) as primers, the first portion of the codon-optimized Δ8 desaturase gene was amplified by PCR. The PCR amplification was carried out in a 50 µl total volume, as described in Example 14. The 309 bp PCR fragment was subcloned into the pGEM-T easy vector (Promega) to generate pT8(1-3).

Using the ligated "Pool 2" mixture (i.e., D84AB, D8-5AB and D8-6AB) as the template, and oligonucleotides D8-4F and D8-6R (SEQ ID NOs:252 and 253) as primers, the second portion of the codon-optimized Δ8 desaturase gene was amplified similarly by PCR and cloned into pGEM-T-easy vector to generate pT8(4-6). Using the ligated "Pool 3" mixture (i.e., D8-7AB, D8-8AB and D8-9AB) as the template and oligonucleotides D8-7F and D8-9R (SEQ ID NOs:254 and 255) as primers, the third portion of the codon-optimized Δ8 desaturase gene was amplified similarly by PCR and cloned into pGEM-T-easy vector to generate pT8(7-9). Finally, using the "Pool 4" ligation mixture (i.e., D8-10AB, D8-11AB, D8-12AB and D8-13AB) as template, and oligonucleotides D8-10F and D8-13R (SEQ ID NOs:256 and 257) as primers, the fourth portion of the codon-optimized Δ8 desaturase gene was amplified similarly by PCR and cloned into pGEM-T-easy vector to generate pT8(10-13).

Figure 14A:
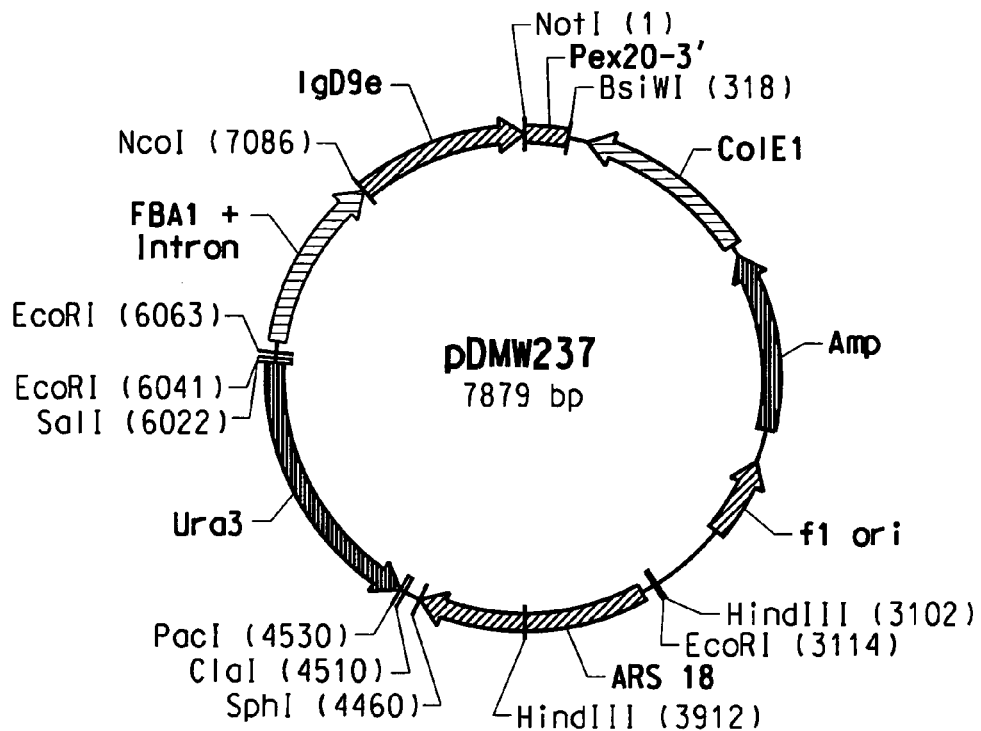
Figure 14B:
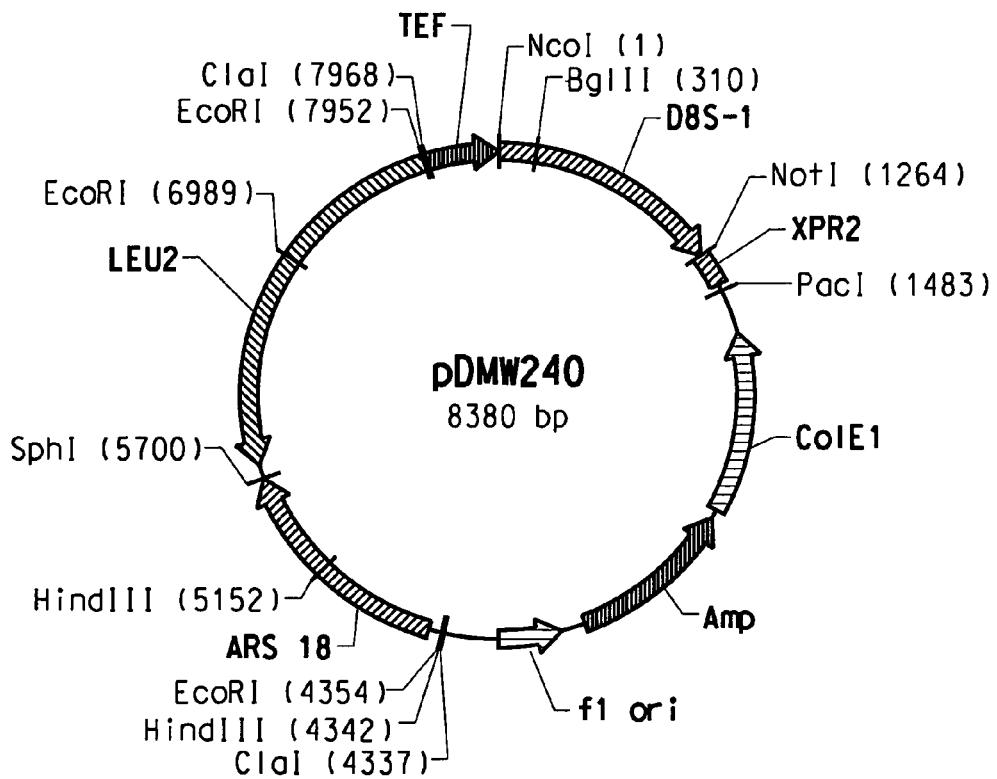

*E. coli* was transformed separately with pT8(1-3), pT8(4-6), pT8(7-9) and pT8(10-13) and the plasmid DNA was isolated from ampicillin-resistant transformants. Plasmid DNA was purified and digested with the appropriate restriction endonucleases to liberate the 309 bp NcoI/BglII fragment of pT8(1-3) (SEQ ID NO:258), the 321 bp BglII/XhoI fragment of pT8(4-6) (SEQ ID NO:259), the 264 bp XhoI/SacI fragment of pT8(7-9) (SEQ ID NO:260) and the 369 bp SacI/NotI fragment of pT8(10-13) (SEQ ID NO:261). These fragments were then combined and directionally ligated together with NcoI/NotI digested pY54PC (SEQ ID NO:145; WO2004/101757) to generate pDMW240 (FIG. 14B). This resulted in a synthetic Δ8 desaturase gene ("D8S-1", SEQ ID NO:55) in pDMW240.

Compared with the published Δ8 desaturase amino acid sequence (SEQ ID NO:53) of *E. gracilis*, the second amino acid of D8S-1 was changed from 'K' to 'E' in order to add the NcoI site around the translation initiation codon. Another version of the synthesized gene, with the exact amino acid sequence as the published *E. gracilis* Δ8 desaturase sequence (SEQ ID NO:53), was constructed by in vitro mutagenesis (Stratagene, San Diego, Calif.) using pDMW240 (FIG. 14B) as a template and oligonucleotides ODMW390 and ODMW391 (SEQ ID NOs:262 and 263) as primers. The resulting plasmid was designated pDMW255. The synthetic Δ8 desaturase gene in pDMW255 was designated as "D8S-2" and the amino acid sequence was exactly the same as the sequence depicted in SEQ ID NO:53.

Nonfunctional Codon-Optimized Δ8 Desaturase Genes

*Yarrowia lipolytica* strain ATCC #76982(Leu-) was transformed with pDMW240 and pDMW255, respectively, as described in the General Methods. Yeast containing the recombinant constructs were grown in MM supplemented with EDA [20:2(11,14)]. Specifically, single colonies of transformant *Y. lipolytica* containing either pDMW240 (containing D8S-1) or pDMW255 (containing D8S-2) were grown in 3 mL MM at 30° C. to an $OD_{600}$~1.0. For substrate feeding, 100 µL of cells were then subcultured in 3 mL MM containing 10 µg of EDA substrate for about 24 hr at 30° C. The cells were collected by centrifugation, lipids were extracted, and fatty acid methyl esters were prepared by transesterification, and subsequently analyzed with a Hewlett-Packard 6890 GC.

Neither transformant produced DGLA from EDA and thus D8S-1 and D8S-2 were not functional and could not desaturate EDA. The chimeric D8S-1::XPR and D8S-2::XPR genes are shown in SEQ ID NOs:264 and 265, respectively.

A three amino acid difference between the protein sequence of the Δ8 desaturase deposited in GenBank (Accession No. AAD45877 [SEQ ID NO:53]) and in WO 00/34439 or Wallis et al. (*Archives of Biochem. Biophys*, 365:307-316 (1999)) (SEQ ID NO:54 herein) was found. Specifically, three amino acids appeared to be missing in GenBank Accession No. MD45877. Using pDMW255 as template and ODMW392 and ODMW393 (SEQ ID NOs:266 and 267) as primers, 9 bp were added into the synthetic D8S-2 gene by in vitro mutagenesis (Stratagene, San Diego, Calif.), thus producing a protein that was identical to the sequence described in WO 00/34439 and Wallis et al. (supra) (SEQ ID NO:54). The resulting plasmid was called pDMW261. The synthetic Δ8 desaturase gene in pDMW261 was designated as "D8S-3" (SEQ ID NO:56). Following transformation of the pDMW261 construct into *Yarrowia*, a similar feeding experiment using EDA was conducted, as described above. No desaturation of EDA to DGLA was observed with D8S-3.

Isolation of a *Euglena gracilis* Δ8 Desaturase Gene

*Euglena gracilis* was obtained from Dr. Richard Triemer's lab at Michigan State University (East Lansing, Mich.). From 10 mL of actively growing culture, a 1 mL aliquot was transferred into 250 mL of *Euglena gracilis* (Eg) Medium in a 500 mL glass bottle. Eg medium was made by combining: 1 g of sodium acetate, 1 g of beef extract (Catalog #U126-01, Difco Laboratories, Detroit, Mich.), 2 g of Bacto®Tryptone (Catalog #0123-17-3, Difco Laboratories) and 2 g of Bacto®Yeast Extract (Catalog #0127-17-9, Difco Laboratories) in 970 mL of water. After filter sterilizing, 30 mL of Soil-Water Supernatant (Catalog #15-3790, Carolina Biological Supply Company, Burlington, N.C.) was aseptically added to produce the final Eg medium. *E. gracilis* cultures were grown at 23° C. with a 16 hr light, 8 hr dark cycle for 2 weeks with no agitation.

After 2 weeks, 10 mL of culture was removed for lipid analysis and centrifuged at 1,800×g for 5 min. The pellet was washed once with water and re-centrifuged. The resulting pellet was dried for 5 min under vacuum, resuspended in 100 µL of trimethylsulfonium hydroxide (TMSH) and incubated at room temperature for 15 min with shaking. After this, 0.5 mL of hexane was added and the vials were incubated for 15 min at room temperature with shaking. Fatty acid methyl esters (5 µL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.7 min, increase to 240° C. at 20° C./min and then hold for an additional 2.3 min. Carrier gas was supplied by a Whatman hydrogen generator. Retention times were compared to those for methyl esters of standards commercially available (Catalog #U-99-A, Nu-Chek Prep, Inc.) and the resulting chromatogram is shown in FIG. 12.

The remaining 2 week culture (240 mL) was pelleted by centrifugation at 1,800×g for 10 min, washed once with water and re-centrifuged. Total RNA was extracted from the resulting pellet using the RNA STAT-60™ reagent (TEL-TEST, Inc., Friendswood, Tex.) and following the manufacturer's protocol provided (use 5 mL of reagent, dissolved RNA in 0.5 mL of water). In this way, 1 mg of total RNA (2 mg/mL) was obtained from the pellet. The mRNA was isolated from 1 mg of total RNA using the mRNA Purification Kit (Amersham Biosciences, Piscataway, N.J.) following the manufacturer's protocol provided. In this way, 85 µg of mRNA was obtained.

cDNA was synthesized from 765 ng of mRNA using the SuperScript™ Choice System for cDNA synthesis (Invitrogen™ Life Technologies, Carlsbad, Calif.) with the provided oligo(dT) primer according to the manufacturer's protocol. The synthesized cDNA was dissolved in 20 µL of water.

The *E. gracilis* Δ8 desaturase was amplified from cDNA with oligonucleotide primers Eg5-1 and Eg3-3 (SEQ ID NOs: 268 and 269) using the conditions described below. Specifically, cDNA (1 µL) was combined with 50 pmol of Eg5-1, 50 pmol of Eg5-1, 1 µL of PCR nucleotide mix (10 mM, Promega, Madison, Wis.), 5 µL of 10×PCR buffer (Invitrogen), 1.5 µL of $MgCl_2$ (50 mM, Invitrogen), 0.5 µL of Taq polymerase (Invitrogen) and water to 50 µL. The reaction conditions were 94° C. for 3 min followed by 35 cycles of 94° C. for 45 sec, 55° C. for 45 sec and 72° C. for 1 min. The PCR was finished at 72° C. for 7 min and then held at 4° C. The PCR reaction was analyzed by agarose gel electrophoresis on 5 µL and a DNA band with molecular weight around 1.3 kB was observed. The remaining 45 µL of product was separated by agarose gel electrophoresis and the DNA band was purified using the Zymoclean™ Gel DNA Recovery Kit (Zymo Research, Orange, Calif.) following the manufacturer's protocol. The resulting DNA was cloned into the pGEM@-T Easy Vector (Promega) following the manufacturer's protocol. Multiple clones were sequenced using T7, M13-28Rev, Eg3-2 and Eg5-2 (SEQ ID NOS:270-273, respectively).

Thus, two classes of DNA sequences were obtained, Eg5 (SEQ ID NO:57) and Eg12 (SEQ ID NO:59), that differed in only a few bp. Translation of Eg5 and Eg12 gave rise to protein sequences that differed in only one amino acid, SEQ ID NO:58 and 60, respectively. Thus, the DNA and protein sequences for Eg5 are set forth in SEQ ID NO:57 and SEQ ID NO:58, respectively; the DNA and protein sequences for Eg12 are set forth in SEQ ID NO:59 and SEQ ID NO:60, respectively.

Comparison of the Isolated *E. gracilis* Δ8 Desaturase Sequences to Published *E. gracilis* Δ8 Desaturase Sequences An alignment of the protein sequences set forth in SEQ ID NO:58 (Eg5) and SEQ ID NO:60 (Eg12) with the protein sequence from GenBank Accession No. AAD45877 (gi: 5639724; SEQ ID NO:53 herein) and with the published protein sequences of Wallis et al. (*Archives of Biochem. Biophys.*, 365:307-316 (1999); WO 00/34439) [SEQ ID NO:54 herein] is shown in FIG. 13. Amino acids conserved among all 4 sequences are indicated with an asterisk (*). Dashes are used by the program to maximize alignment of the sequences. The putative cytochrome $b_5$ domain is underlined. A putative His box is shown in bold. Percent identity calculations revealed that the Eg5 Δ8 desaturase protein sequence is 95.5% identical to SEQ ID NO:53 and 96.2% identical to SEQ ID NO:54, wherein "% identity" is defined as the percentage of amino acids that are identical between the two proteins. Sequence alignments and percent identity calculations were performed using the Megalign program of the LASERGENE bioinformatics computing suite (DNASTAR Inc., Madison, Wis.). Multiple alignment of the sequences was performed using the Clustal method of alignment (Higgins and Sharp, *CABIOS*. 5:151-153 (1989)) with default parameters (GAP PENALTY=10, GAP LENGTH PENALTY=10). Default parameters for pairwise alignments using the Clustal method were KTUPLE 1, GAP PENALTY=3, WINDOW=5 and DIAGONALS SAVED=5. For a more complete analysis of the differences between the various *E. gracilis* Δ8 desaturase sequences, refer to co-pending U.S. patent application Ser. No. 11/166,993.

Functional Analysis of the *Euglena Gracilis* Δ8 Desaturase Sequences in *Saccharomyces Cerevisiae*

Figure 14C:
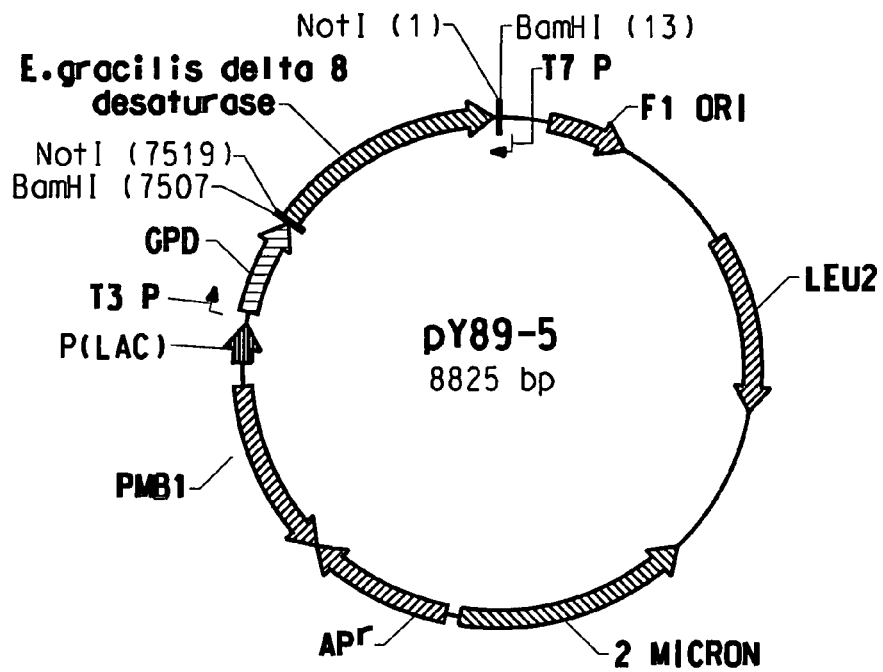
Figure 14D:
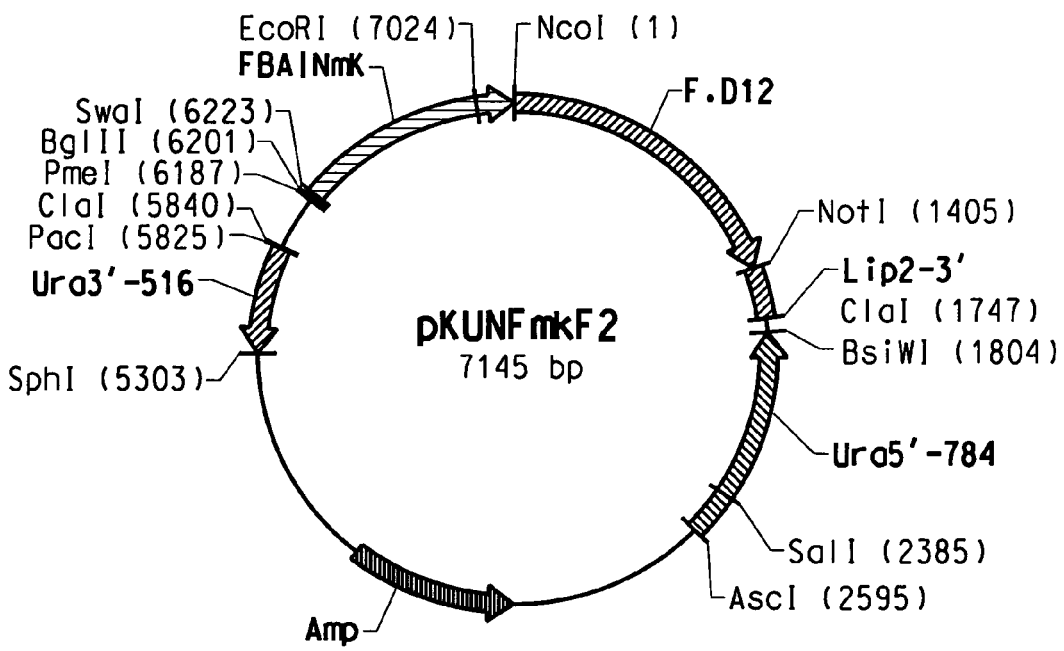

The yeast episomal plasmid (YEp)-type vector pRS425 (Christianson et al., *Gene*, 110:119-22 (1992)) contains sequences from the *Saccharomyces cerevisiae* 2µ endogenous plasmid, a LEU2 selectable marker and sequences based on the backbone of a multifunctional phagemid, pBluescript II SK+. The *S. cerevisiae* strong, constitutive glyceraldehyde-3-phosphate dehydrogenase (GPD) promoter was cloned between the SacII and SpeI sites of pRS425 in the same way as described in Jia et al. (*Physiological Genomics*, 3:83-92 (2000)) to produce pGPD-425. A NotI site was introduced into the BamHI site of pGPD-425 (thus producing a NotI site flanked by BamHI sites), thereby resulting in plasmid pY-75. Eg5 (SEQ ID NO:57) and Eg12 (SEQ ID NO:59) were released from the PGEM® T Easy vectors described above by digestion with NotI and cloned into the NotI site of pY-75 to produce pY89-5 (deposited as ATCC #PTA-6048) and pY89-12, respectively. In this way, the Δ8 desaturases (i.e., Eg5 [SEQ ID NO:57] and Eg12 [SEQ ID NO:59]) were cloned behind a strong constitutive promoter for expression in *S. cerevisiae*. A map of pY89-5 is shown in FIG. 14C.

Plasmids pY89-5, pY89-12 and pY-75 were transformed into *Saccharomyces cerevisiae* BY4741 (ATCC #201388) using standard lithium acetate transformation procedures. Transformants were selected on DOBA media supplemented with CSM-leu (Qbiogene, Carlsbad, Calif.). Transformants from each plate were inoculated into 2 mL of DOB medium supplemented with CSM-leu (Qbiogene) and grown for 1 day at 30° C., after which 0.5 mL was transferred to the same medium supplemented with either EDA or EtrA to 1 mM. These were incubated overnight at 30° C., 250 rpm, and pellets were obtained by centrifugation and dried under vacuum. Pellets were transesterified with 50 µL of TMSH and analyzed by GC as described in the General Methods. Two clones for pY-75 (i.e., clones 75-1 and 75-2) and pY89-5 (i.e., clones 5-6-1 and 5-6-2) were each analyzed, while two sets of clones for pY89-12 (i.e., clones 12-8-1, 12-8-2, 12-9-1 and 12-9-2) from two independent transformations were analyzed.

The lipid profile obtained by GC analysis of clones fed EDA are shown in Table 29; and the lipid profile obtained by GC analysis of clones fed EtrA are shown in Table 30. Fatty acids are identified as 16:0 (palmitate), 16:1 (palmitoleic acid), 18:0,18:1 (oleic acid), 20:2 [EDA], 20:3 (8,11,14) [DGLA], 20:3 (11,14,17) [ETrA] and 20:4 (8,11,14) [ETA]; and the composition of each is presented as a % of the total fatty acids.

TABLE 29

Lipid Analysis Of Transformant *S. cerevisiae* Overexpressing The *Euglena gracilis* Δ8 Desaturases: EDA Substrate Feeding

| Clone | 16:0 | 16:1 | 18:0 | 18:1 | 20:2 | 20:3 (8, 11, 14) | % 20:2 Converted |
|---|---|---|---|---|---|---|---|
| 75-1 (control) | 14 | 32 | 5 | 38 | 10 | 0 | 0 |
| 75-2 (control) | 14 | 31 | 5 | 41 | 9 | 0 | 0 |
| 5-6-1 (Eg5) | 14 | 32 | 6 | 40 | 6 | 2 | 24 |
| 5-6-2 (Eg5) | 14 | 30 | 6 | 41 | 7 | 2 | 19 |
| 12-8-1 (Eg12) | 14 | 30 | 6 | 41 | 9 | 1 | 7 |
| 12-8-2 (Eg12) | 14 | 32 | 5 | 41 | 8 | 1 | 8 |
| 12-9-1 (Eg12) | 14 | 31 | 5 | 40 | 9 | 1 | 8 |
| 12-9-2 (Eg12) | 14 | 32 | 5 | 41 | 8 | 1 | 7 |

TABLE 30

Lipid Analysis Of Transformant *S. cerevisiae* Overexpressing The *Euglena gracilis* Δ8 Desaturases: ETrA Substrate Feeding

| Clone | 16:0 | 16:1 | 18:0 | 18:1 | 20:3 (11, 14, 17) | 20:4 (8, 11, 14, 17) | % 20:3 Converted |
|---|---|---|---|---|---|---|---|
| 75-1 (control) | 12 | 25 | 5 | 33 | 24 | 0 | 0 |
| 75-2 (control) | 12 | 24 | 5 | 36 | 22 | 1 | 5 |
| 5-6-1 (Eg5) | 13 | 25 | 6 | 34 | 15 | 7 | 32 |
| 5-6-2 (Eg5) | 13 | 24 | 6 | 34 | 17 | 6 | 27 |
| 12-8-1 (Eg12) | 12 | 24 | 5 | 34 | 22 | 2 | 8 |
| 12-8-2 (Eg12) | 12 | 25 | 5 | 35 | 20 | 2 | 9 |
| 12-9-1 (Eg12) | 12 | 24 | 5 | 34 | 22 | 2 | 9 |
| 12-9-2 (Eg12) | 12 | 25 | 6 | 35 | 20 | 2 | 9 |

The data in Tables 29 and 30 showed that the cloned *Euglena* Δ8 desaturases were able to desaturate EDA and EtrA. The sequence set forth in SEQ ID NO:60 has one amino acid change compared to the sequence set forth in SEQ ID NO:58 and has reduced Δ8 desaturase activity.

The small amount of 20:4(8,11,14,17) generated by clone 75-2 in Table 30 had a slightly different retention time than a standard for 20:4(8,11,14,17). This peak was more likely a small amount of a different fatty acid generated by the wild-type yeast in that experiment.

Further Modification of the Δ8 Desaturase Gene Codon-Optimized for *Yarrowia Lipolytica*

Figure 15A:
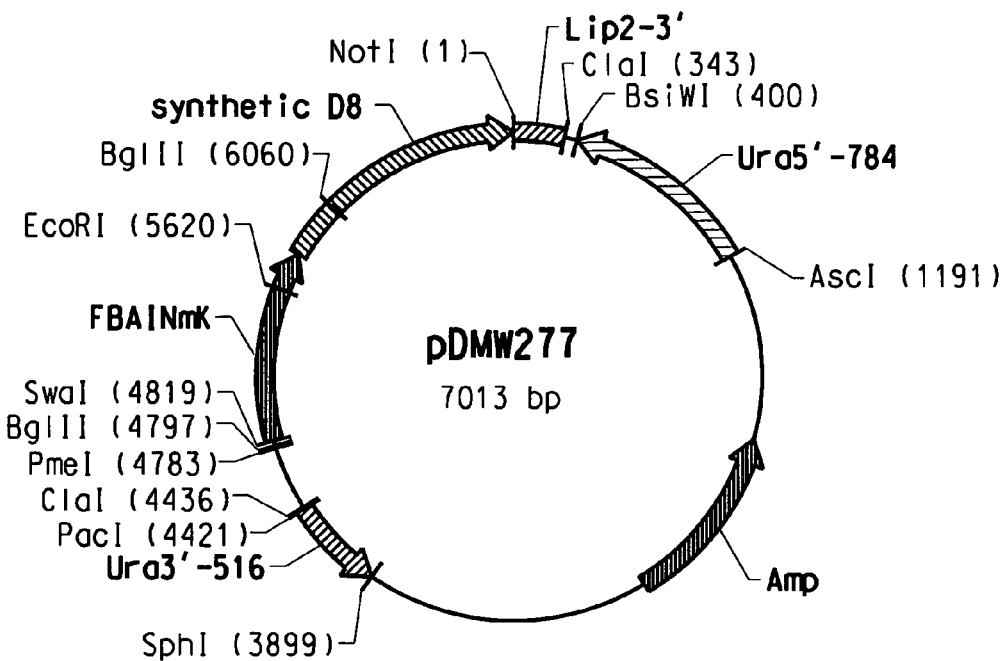
Figure 15B:
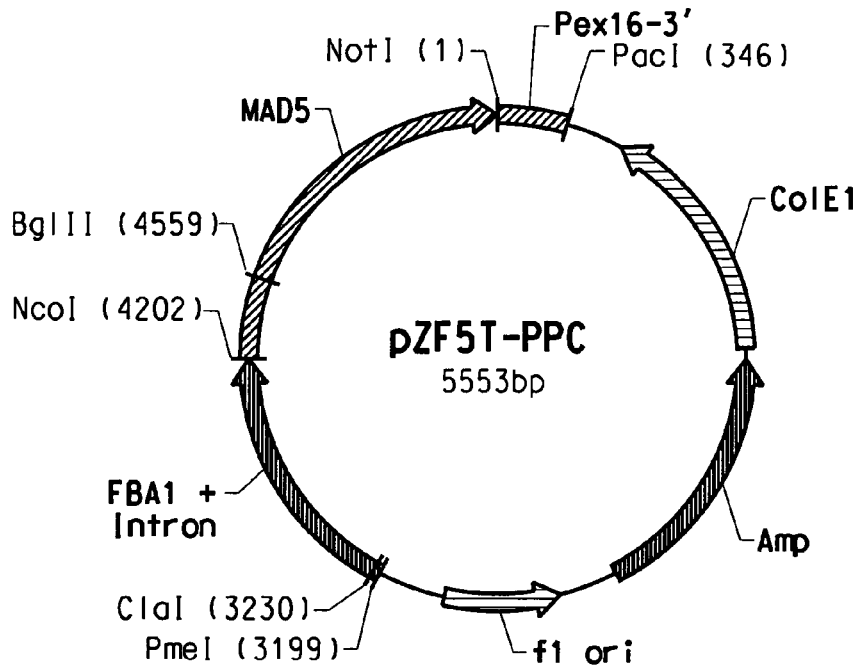
Figure 15C:
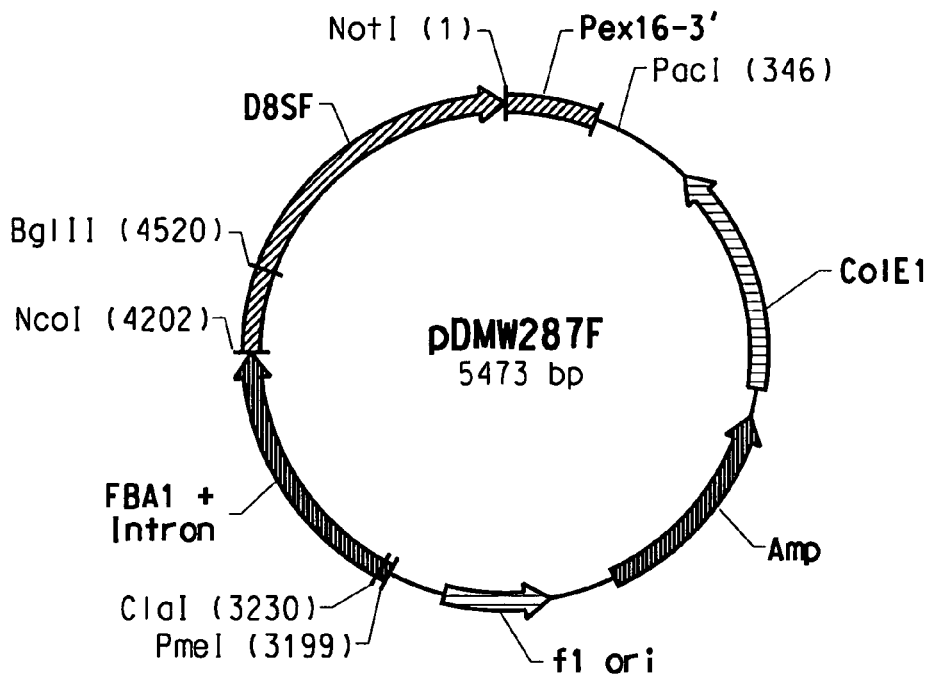

The amino acid sequence of the synthetic D8S-3 gene in pDMW261 was corrected according to the amino acid sequence of the functional *Euglena* Δ8 desaturase (SEQ ID NOs:57 and 58). Using pDMW261 as a template and oligonucleotides ODMW404 (SEQ ID NO:274) and D8-13R (SEQ ID NO:257), the DNA fragment encoding the synthetic D8S-3 desaturase gene was amplified. The resulting PCR fragment was purified with Bio101's Geneclean kit and subsequently digested with KpnI and NotI (primer ODMW404 introduced a KpnI site while primer D8-13R introduced a NotI site). The KpnI/NotI fragment (SEQ ID NO:275) was cloned into KpnI/NotI digested pKUNFmKF2 (FIG. 14D; SEQ ID NO:146) to produce pDMW277 (FIG. 15A).

Oligonucleotides YL521 and YL522 (SEQ ID NOs:276 and 277), which were designed to amplify and correct the 5' end of the D8S-3 gene, were used as primers in another PCR reaction where pDMW277 was used as the template. The primers introduced into the PCR fragment a NcoI site and BglII site at its 5' and 3' ends, respectively. The 318 bp PCR product was purified with Bio 101's GeneClean kit and subsequently digested with NcoI and BglII. The digested fragment, along with the 954 bp BglII/NotI fragment from pDMW277, was used to exchange the NcoI/NotI fragment of pZF5T-PPC (FIG. 15B; SEQ ID NO:147) to form pDMW287. In addition to correcting the 5' end of the synthetic D8S-3 gene, this cloning reaction also placed the synthetic Δ8 desaturase gene under control of the *Yarrowia lipolytica* FBAIN promoter (SEQ ID NO:177).

The first reaction in a final series of site-directed mutagenesis reactions was then performed on pDMW287. The first set of primers, YL525 and YL526 (SEQ ID NOs:278 and 279), was designed to correct amino acid from F to S (position #50) of the synthetic D8S-3 gene in pDMW287. The plasmid resulting from this mutagenesis reaction then became the template for the next site-directed mutagenesis reaction with primers YL527 and YL528 (SEQ ID NOs:280 and 281). These primers were designed to correct the amino acid from F to S (position #67) of the D8S-3 gene and resulted in creation of plasmid pDMW287/YL527.

To complete the sequence corrections within the second quarter of the gene, the following reactions were carried out concurrently with the mutations on the first quarter of the gene. Using pDMW287 as template and oligonucleotides YL529 and YL530 (SEQ ID NOs:282 and 283) as primers, an in vitro mutagenesis reaction was carried out to correct the amino acid from C to W (position #177) of the synthetic D8S-3 gene. The product (i.e., pDMW287/Y529) of this mutagenesis reaction was used as the template in the following reaction using primers YL531 and YL532 (SEQ ID NOs: 284 and 285) to correct the amino acid from P to L (position #213). The product of this reaction was called pDMW287/YL529-31.

Concurrently with the mutations on the first and second quarter of the gene, reactions were similarly carried out on the 3' end of the gene. Each subsequent mutagenesis reaction used the plasmid product from the preceding reaction. Primers YL533 and YL534 (SEQ ID NOs:286 and 287) were used on pDMW287 to correct the amino acid from C to S (position #244) to create pDMW287/YL533. Primers YL535 and YL536 (SEQ ID NOs:288 and 289) were used to correct the amino acid A to T (position #280) in the synthetic D8S-3 gene of pDMW287/YL533 to form pDMW287/YL533-5. Finally, the amino acid P at position #333 was corrected to S in the synthetic D8S-3 gene using pDMW287/YL533-5 as the template and YL537 and YL538 (SEQ ID NOs:290 and 291) as primers. The resulting plasmid was named pDMW287/YL533-5-7.

The BglII/XhoI fragment of pDMW287/YL529-31 and the XhoI/NotI fragment of pDMW287/YL533-5-7 were used to change the BglII/NotI fragment of pDMW287/YL257 to produce pDMW287F (FIG. 15C) containing the completely corrected synthetic Δ8 desaturase gene, designated D8SF and set forth in SEQ ID NO:61. SEQ ID NO:62 sets forth the amino acid sequence encoded by nucleotides 2-1270 of SEQ ID NO:61, which is essentially the same as the sequence set forth in SEQ ID NO:58, except for an additional valine following the start methionine.

Example 16

Functional Expression of the Codon-Optimized Δ9 Elongase Gene and Codon-Optimized Δ8 Desaturase in *Yarrowia lipolytica*

The present Example describes DGLA biosynthesis and accumulation in *Yarrowia lipolytica* that was transformed to co-express the codon-optimized Δ9 elongase and codon-optimized Δ8 desaturase from Examples 14 and 15. This experiment thereby confirmed both genes' activity and *Y. lipolytica*'s ability to express the Δ9 elongase/Δ8 desaturase pathway.

Figure 15D:
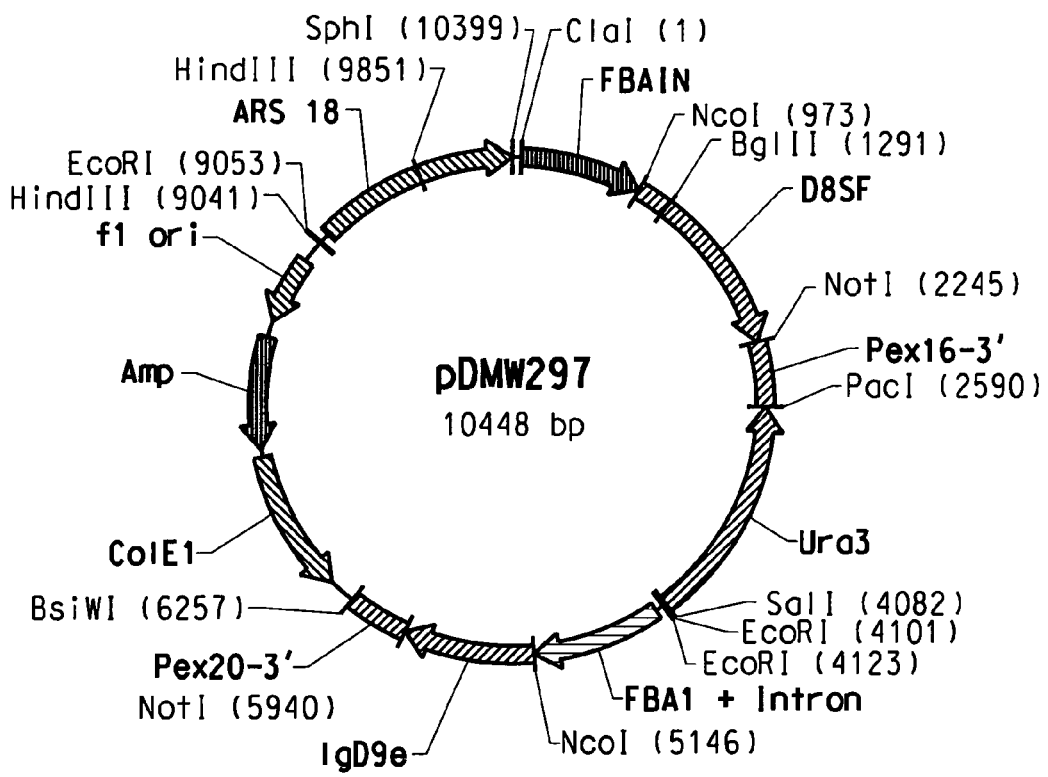
Figure 16A:
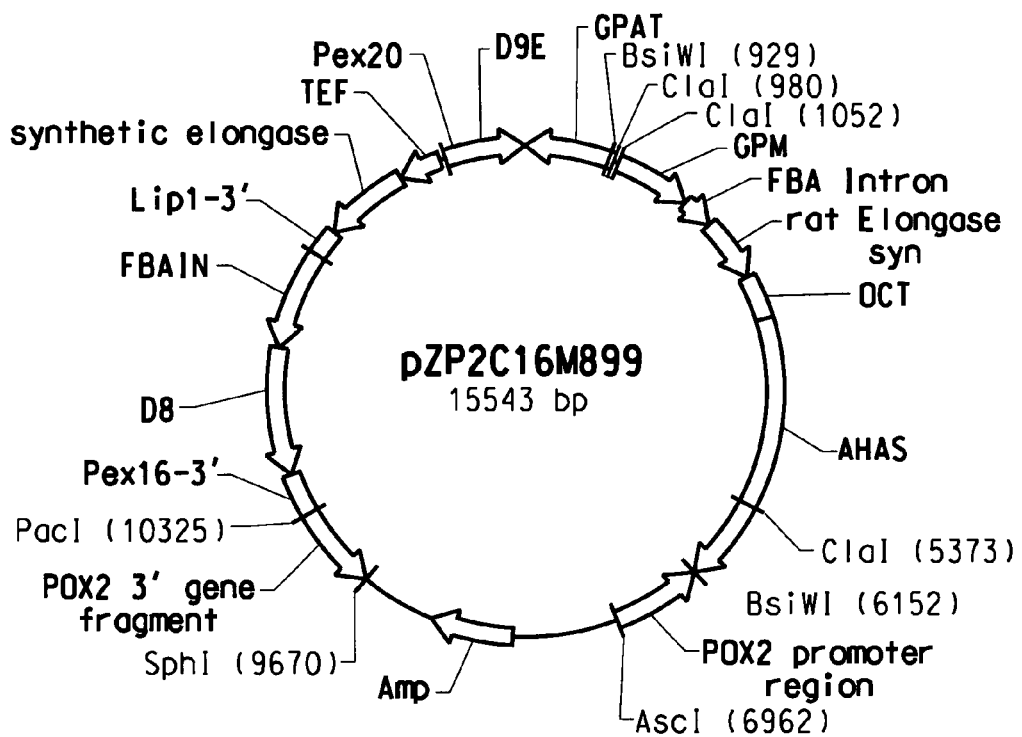
Figure 16B:
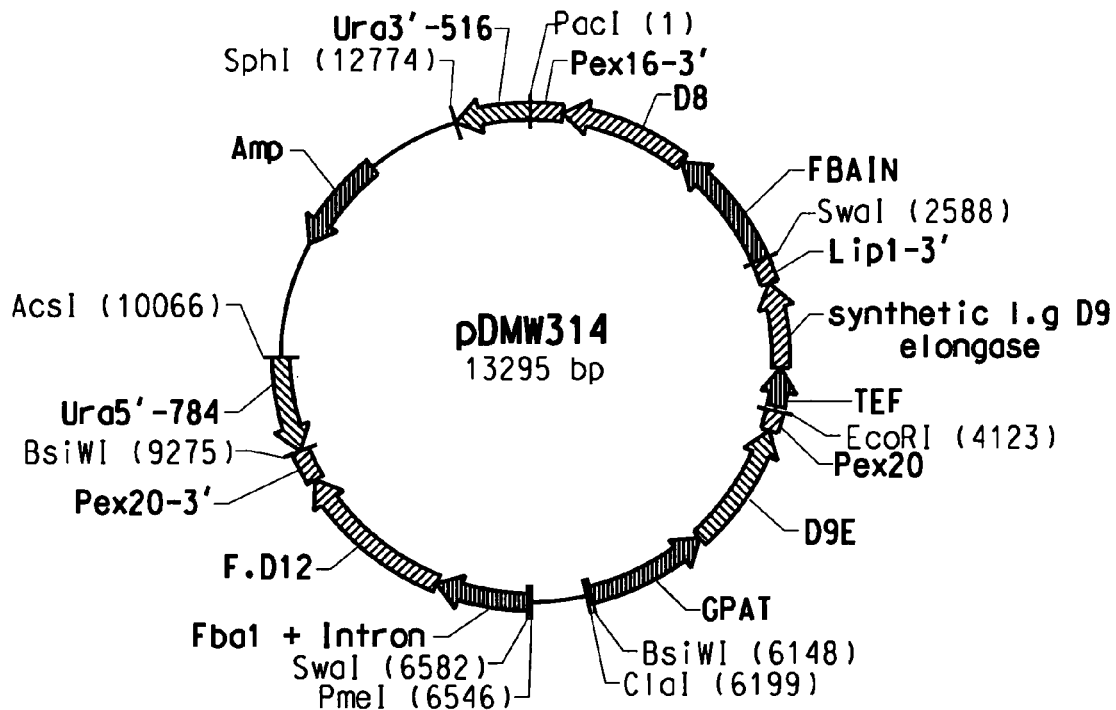
Figure 16C:
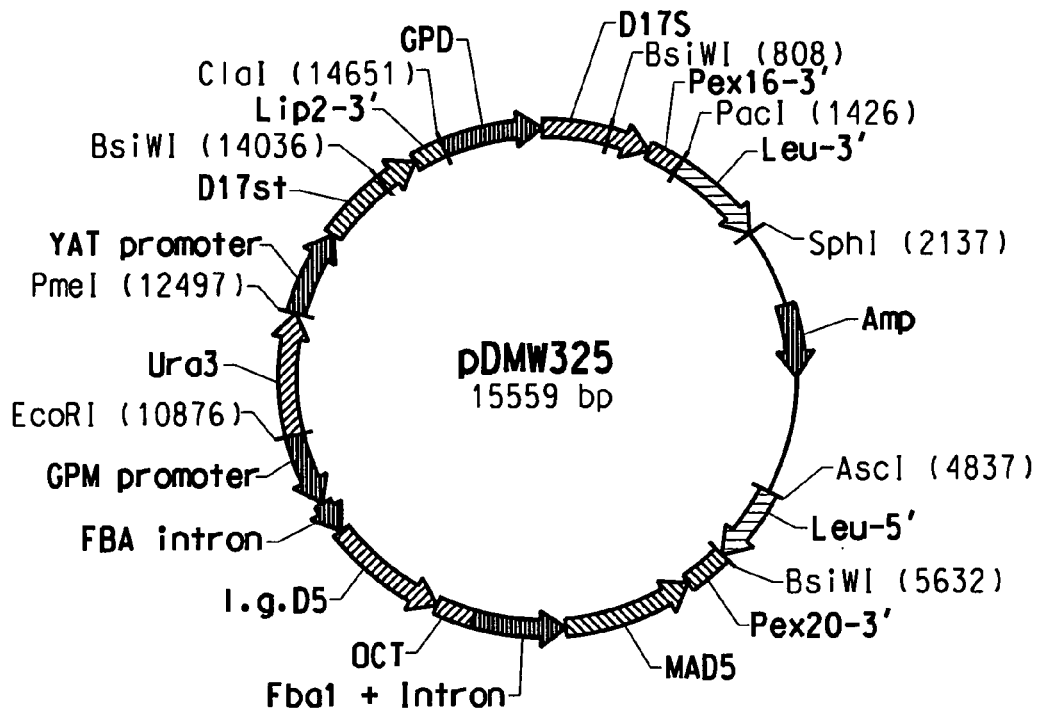
Figure 16D:
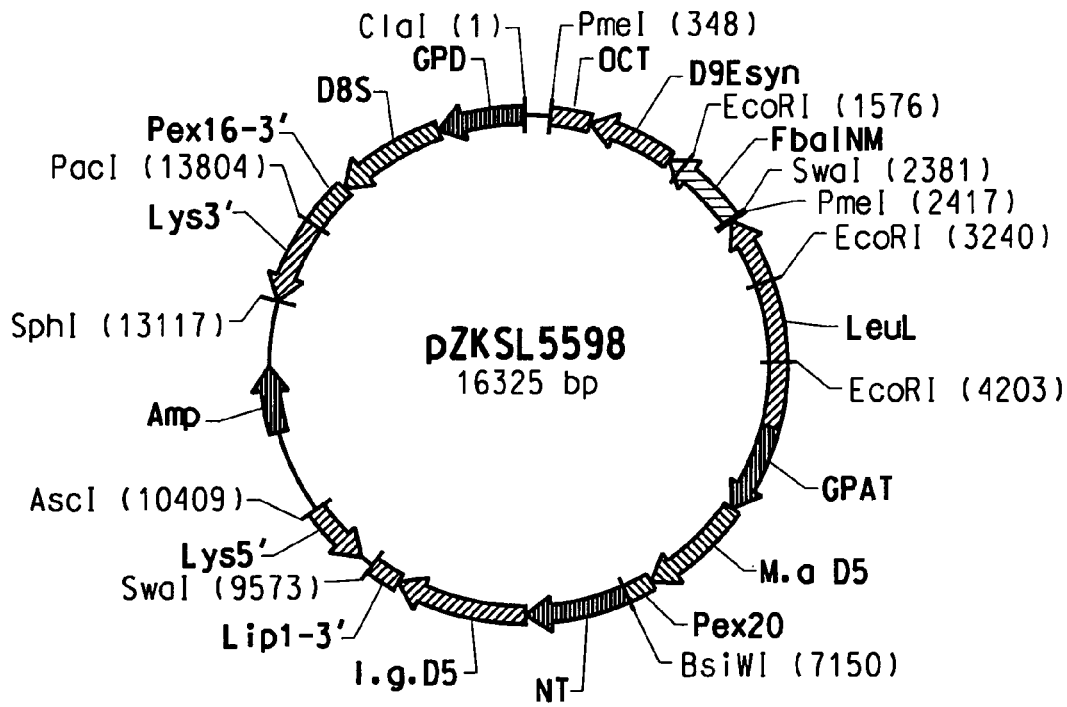
Figure 17A:
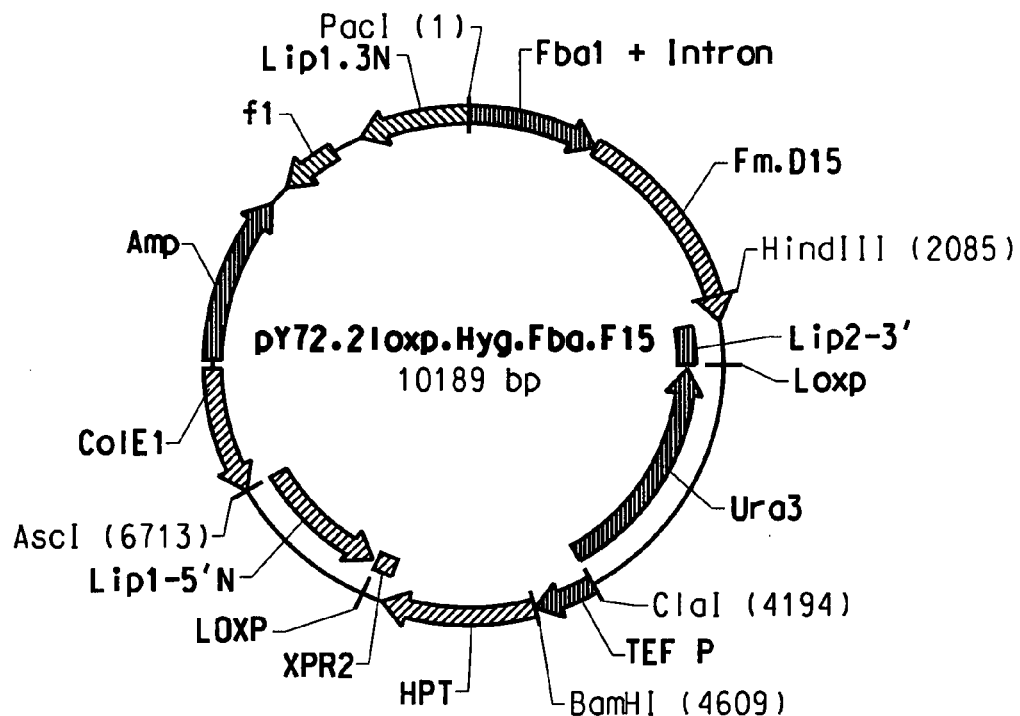
Figure 17B:
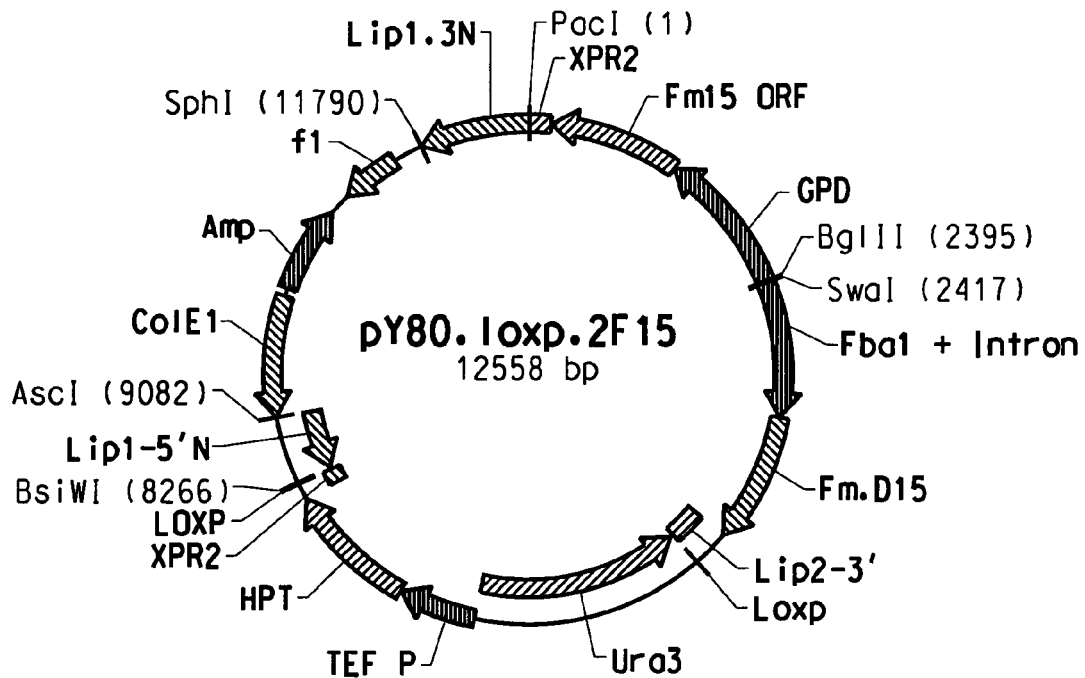
Figure 17C:
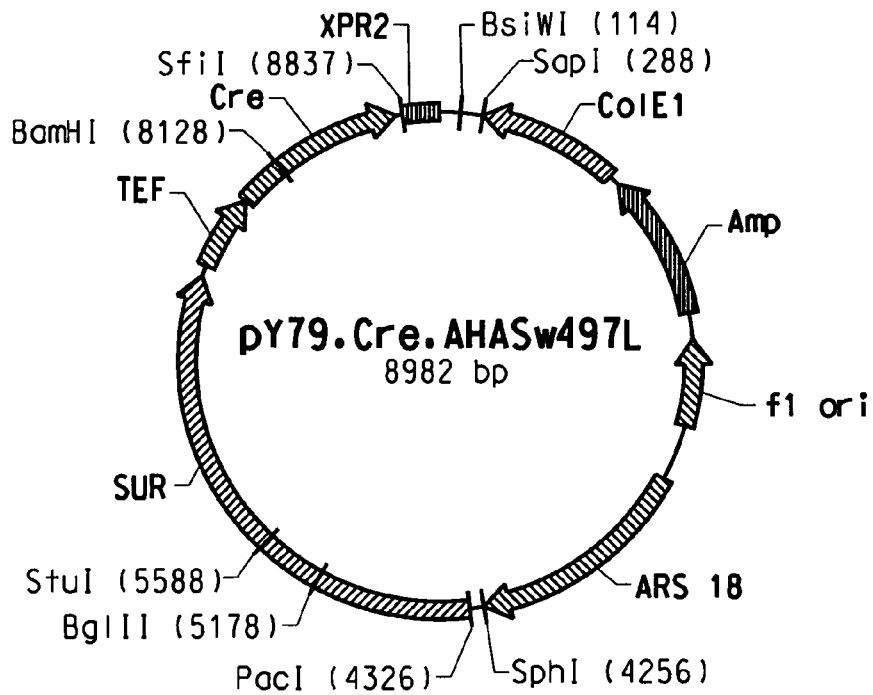
Figure 17D:
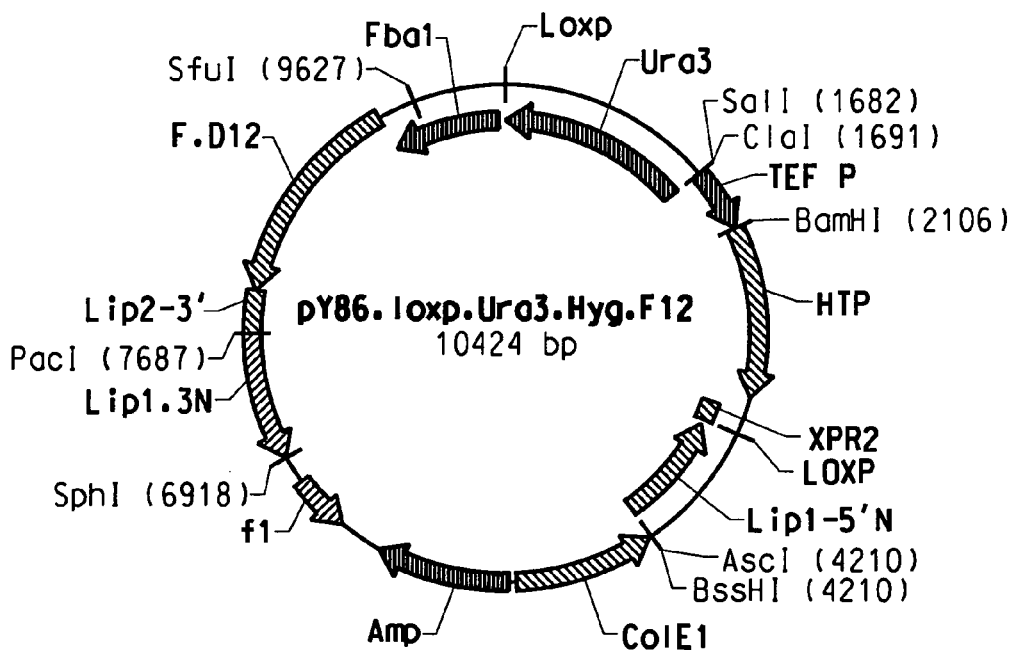

Specifically, the ClaI/PacI fragment comprising a chimeric FBAIN::D8SF::Pex16 gene of construct pDMW287F (Example 15) was inserted into the ClaI/PacI sites of pDMW237 (Example 14) to generate the construct pDMW297 (FIG. 15D; SED ID NO:148).

Plasmid pDMW297 contained the following components:

TABLE 31

Description of Plasmid pDMW297 (SEQ ID NO: 148)

| RE Sites And Nucleotides Within SEQ ID NO: 148 | Description Of Fragment And Chimeric Gene Components |
|---|---|
| EcoRI/ClaI (9053-10448) | ARS18 sequence (GenBank Accession No. A17608) |
| ClaI/PacI (1-2590) | FBAIN::D8SF::Pex16, comprising: FBAIN: FBAIN promoter (SEQ ID NO: 177) D8SF: codon-optimized Δ8 desaturase gene (SEQ ID NO: 61), derived from *Euglena gracilis* (GenBank Accession No. AF139720) Pex16: Pex16 terminator sequence of *Yarrowia* Pex16 gene (GenBank Accession No. U75433) |
| PacI/SalI (2590-4082) | *Yarrowia* Ura3 gene (GenBank Accession No. AJ306421) |
| SalI/BsiWI (4082-6257) | FBAIN::IgD9e::Pex20, comprising: FBAIN: FBAIN promoter (SEQ ID NO: 177) IgD9e: codon-optimized Δ9 elongase gene (SEQ ID NO: 51), derived from *Isochrysis galbana* (GenBank Accession No. 390174) Pex20: Pex20 terminator sequence of *Yarrowia* Pex20 gene (GenBank Accession No. AF054613) |

Construct pDMW297 was then used for transformation of strain Y2031 (Example 13) according to the General Methods. The transformant cells were plated onto MM selection media plates and maintained at 30° C. for 2 to 3 days. A total of 8 transformants grown on the MM plates were picked and re-streaked onto fresh MM plates. Once grown, these strains were individually inoculated into liquid MM at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed that DGLA was produced in all of the transformants analyzed. One strain produced about 3.2%, 4 strains produced 4.3-4.5%, two strains produced 5.5-5.8% and one strain produced 6.4% DGLA (designated herein as strain "Y0489"). The "percent (%) substrate conversion" of the codon-optimized D8SF gene in strain Y0489 was determined to be 75%.

Example 17

The ω-6 Δ9 Elongase/Δ8 Desaturase Pathway: Generation Of Y2201 and Y2203 Strains to Produce About 9% EPA of Total Lipids The present Example describes the construction of strains Y2201 and Y2203, derived from *Yarrowia lipolytica* ATCC #20362, capable of producing about 9% EPA relative to the total lipids (FIG. 5). This strain was engineered to express the ω-6 Δ9 elongase/Δ8 desaturase pathway; thus, analysis of the complete lipid profiles of strains Y2201 and Y2203 indicating no GLA co-synthesis in the final EPA-containing oil was expected.

The development of strains Y2201 and Y2203 herein required the construction of strains Y2152 and Y2153 (producing ~3.5% DGLA), strain Y2173 (producing 14% DGLA), and strain Y2189 (producing 5% EPA).

Generation of Strains Y2152 and Y2153 to Produce About ~3.5% DGLA of Total Lipids Construct pZP2C16M899 (FIG. 16A, SEQ ID NO:149) was used to integrate a cluster of four chimeric genes (comprising two Δ9 elongases, a synthetic $C_{16/18}$ fatty acid elongase and a Δ8 desaturase), as well as a *Yarrowia* AHAS gene (acetohydroxy-acid synthase) containing a single amino acid mutation. The mutated AHAS enzyme in *Yarrowia* conferred resistance to sulfonylurea, which was used as a positive screening marker. Plasmid pZP2C16M899 was designed to integrate into the Pox2 gene site of *Yarrowia* strain ATCC #20362 and thus contained the following components:

TABLE 32

Description of Plasmid pZP2C16M899 (SEQ ID NO: 149)

| RE Sites And Nucleotides Within SEQ ID NO: 149 | Description Of Fragment And Chimeric Gene Components |
|---|---|
| BsiWI/AscI (6152-6962) | 810 bp 5' part of *Yarrowia* Aco2 gene (GenBank Accession No. AJ001300) |
| SphI/EcoRI (9670-10325) | 655 bp 3' part of *Yarrowia* Aco2 gene (GenBank Accession No. AJ001300) |
| BsiWI/PmeI with EcoRV (929-3195) | GPM/FBAintron::rELO2S::Oct, comprising: GPM/FBAIN: GPM::FBAIN chimeric promoter (SEQ ID NO: 182) rELO2S: codon-optimized rELO2 elongase gene (SEQ ID NO: 65), derived from rat (GenBank Accession No. AB071986) OCT: OCT terminator sequence of *Yarrowia* OCT gene (GenBank Accession No. X69988) |
| BsiWI/EcoRI (929-14447, reverse) | GPAT::IgD9e::Pex20, comprising: GPAT: GPAT promoter (SEQ ID NO: 179) IgD9e: codon-optimized Δ9 elongase gene (SEQ ID NO: 51), derived from *I. galbana* Pex20: Pex20 terminator sequence of *Yarrowia* Pex20 gene (GenBank Accession No. AF054613) |
| EcoRI/SwaI (14447-12912) | TEF::IgD9e::Lip1, comprising: TEF: TEF promoter (GenBank Accession No. AF054508) IgD9e: SEQ ID NO: 51 (supra) Lip1: Lip1 terminator sequence of *Yarrowia* Lip1 gene (GenBank Accession No. Z50020) |
| SwaI/PacI (12912-10325) | FBAIN::D8SF::Pex16, comprising: FBAIN: FBAIN promoter (SEQ ID NO: 177) D8SF: codon-optimized Δ8 desaturase gene (SEQ ID NO: 61), derived from *Euglena gracilis* (GenBank Accession No. AF139720) Pex16: Pex16 terminator sequence of *Yarrowia* Pex16 gene (GenBank Accession No. U75433) gene |
| PmeI with EcoRV/ BsiWI (3195-6152) | *Yarrowia lipolytica* AHAS gene comprising a W497L mutation (SEQ ID NO: 292) |

Plasmid pZP2C16M899 was digested with SphI/AscI, and then used to transform ATCC #20362 according to the General Methods. Following transformation, cells were plated onto MM plates containing 150 mg sulfonylurea and maintained at 30° C. for 2 to 3 days. The sulfonylurea resistant colonies were picked and streaked onto MM with sulfonylurea selection plates. A total of 96 transformants were then inoculated into liquid MM with sulfonylurea at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of DGLA in the transformants containing the 4 chimeric genes of pZP2C16M899, but not in the wild type *Yarrowia* control strain. Most of the selected 96 strains produced less than 2% DGLA of total lipids. There were 28 strains that produced 2-2.9% DGLA of total lipids. There were 2 strains that produced about 3.5% DGLA of total lipids. Strains #65 and #73 were designated herein as strains "Y2152" and "Y2153", respectively.

Generation of Strains Y2173 and Y2175 to Produce About 14-16% DGLA of Total Lipids Construct pDMW314 (FIG. 16B, SEQ ID NO:150) was used to integrate a cluster of four chimeric genes (comprising two Δ9 elongases, a Δ8 desaturase and a Δ12 desaturase) into the Ura3 gene site of *Yarrowia* strains Y2152 and Y2153, to thereby enhance production of DGLA. Plasmid pDMW314 contained the following components:

TABLE 33

Description of Plasmid pDMW314 (SEQ ID NO: 150)

| RE Sites And Nucleotides Within SEQ ID NO: 150 | Description Of Fragment And Chimeric Gene Components |
|---|---|
| AscI/BsiWI (10066-9275) | 784 bp 5' part of *Yarrowia* Ura3 gene (GenBank Accession No. AJ306421) |
| SphI/PacI (12774-1) | 516 bp 3' part of *Yarrowia* Ura3 gene (GenBank Accession No. AJ306421) |
| SwaI/BsiWI (6582-9275) | FBAIN::F.D12S::Pex20, comprising: FBAIN: FBAIN promoter (SEQ ID NO: 177) F.Δ12: *Fusarium moniliforme* Δ12 desaturase gene (SEQ ID NO: 27) Pex20: Pex20 terminator sequence from *Yarrowia* Pex20 gene (GenBank Accession No. AF054613) |
| ClaI/EcoRI (6199-4123) | GPAT::IgD9E::Pex20: as described for pZP2C16M899 (supra) |
| EcoRI/SwaI (4123-2588) | TEF::IgD9E::Lip1: as described for pZP2C16M899 (supra) |
| SwaI/PacI (2588-1) | FBAIN::D8SF::Pex16: as described for pZP2C16M899 (supra) |

Plasmid pDMW314 was digested with AscI/SphI, and then used for transformation of *Y. lipolytica* strains Y2152 and Y2153 according to the General Methods. The transformant cells were plated onto FOA selection media plates and maintained at 30° C. for 2 to 3 days. The FOA resistant colonies were picked and streaked onto MM and MMU selection plates. The colonies that could grow on MMU plates but not on MM plates were selected as Ura– strains. Single colonies of Ura– strains were then inoculated into liquid MMU at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed increased production of DGLA in almost all transformants containing the 4 chimeric genes of pDMW314. Most of the selected 48 Ura⁻ strains of Y2152 with pDMW314 produced about 6-8% DGLA of total lipids. There was one strain (i.e., #47, designated herein as "Y2173") that produced about 13.9% DGLA of total lipids.

Similarly, most of the selected 24 Ura⁻ strains of Y2153 with pDMW314 produced about 6-8% DGLA of total lipids. There were two strains (i.e., #6 and #11, designated herein as strains "Y2175" and "Y2176") that produced about 16.3% and 17.2% DGLA of total lipids, respectively.

Generation of Strain Y2189 to Produce About 4.8% EPA of Total Lipids

Construct pDMW325 (FIG. 16C, SEQ ID NO:151) was used to integrate a cluster of four chimeric genes (comprising two Δ5 desaturases and two Δ17 desaturases) into the Leu2 gene site of *Yarrowia* Y2173 strain to thereby enable production of EPA. Plasmid pDMW325 contained the following components:

TABLE 34

Description Of Plasmid pDMW325 (SEQ ID NO: 151)

| RE Sites And Nucleotides Within SEQ ID NO: 151 | Description Of Fragment And Chimeric Gene Components |
|---|---|
| AscI/BsiWI (4837-5632) | 788 bp 5' part of *Yarrowia* Leu2 gene (GenBank Accession No. AF260230) |
| SphI/PacI (2137-1426) | 703 bp 3' part of *Yarrowia* Leu2 gene (GenBank Accession No. AF260230) |
| SwaI with PmeI/BsiWI (8277-5632) | FBAIN::MAΔ5::Pex20, comprising: FBAIN: FBAIN promoter (SEQ ID NO: 177) MAΔ5: *Mortierella alpina* Δ5 desaturase gene (SEQ ID NO: 6) (GenBank Accession No. AF067654) Pex20: Pex20 terminator sequence of *Yarrowia* Pex20 gene (GenBank Accession No. AF054613) |
| EcoRI/SwaI with PmeI (10876-8278) | GPM/FBAIN::I.Δ5S::Oct, comprising: GPM/FBAIN: GPM::FBAIN chimeric promoter (SEQ ID NO: 182) I.Δ5S: codon-optimized Δ5 desaturase gene (SEQ ID NO: 10), derived from *Isochrysis galbana* (WO 2002/081668) OCT: OCT terminator sequence of *Yarrowia* OCT gene (GenBank Accession No. X69988) |
| EcoRI/PmeI (10876-12497) | *Yarrowia* Ura3 gene (GenBank Accession No. AJ306421) |
| PmeI/ClaI (12497-14651) | YAT::D17S::Lip2, comprising: YAT: YAT1 promoter (SEQ ID NO: 180) Δ17S: codon-optimized Δ17 desaturase gene (SEQ ID NO: 16), derived from *S. diclina* Lip2: Lip2 terminator of *Yarrowia* lipase2 gene (GenBank Accession No. AJ012632) |
| ClaI/PacI (14651-1426) | GPD::D17S::Pex16, comprising: GPD: GPD promoter (SEQ ID NO: 173) Δ17S: SEQ ID NO: 16 (supra) Pex16: Pex16 terminator sequence of *Yarrowia* Pex16 gene (GenBank Accession No. U75433). |

Plasmid pDMW325 was digested with AscI/SphI, and then used to transform strain Y2173 according to the General Methods. Following transformation, the cells were plated onto MMLe plates and maintained at 30° C. for 2 to 3 days. The individual colonies grown on MMLe plates from each transformation were picked and streaked onto MM and MMLe plates. Those colonies that could grow on MMLe plates but not on MM plates were selected as Leu2⁻ strains. Single colonies of Leu2⁻ strains were then inoculated into liquid MMLe media at 30° C. and shaken at 250 rpm/min for 2 days. The cells were collected by centrifugation, lipids were extracted, and fatty acid methyl esters were prepared by trans-esterification, and subsequently analyzed with a Hewlett-Packard 6890 GC.

GC analyses showed the presence of EPA in pDMW325 transformants, but not in the parental Y2173 strain. Specifically, among the 48 selected Leu2⁻ transformants of Y2173 with pDMW325, most strains produced less than 3% EPA of total lipids. There were two strains (i.e., #21 and #46, designated herein as "Y2189" and "Y2190") that produced about 4.8% and 3.4% EPA of total lipids, respectively.

Generation of Strains Y2201 and Y2203 to Produce About 9% EPA of Total Lipids

Construct pZKSL5598 (FIG. 16D, SEQ ID NO:152) was used to integrate a cluster of four chimeric genes (comprising a Δ9 elongase, a Δ8 desaturase and two Δ5 desaturases) into the Lys5 gene (GenBank Accession No. M34929) site of Yarrowia Y2189 strain to thereby enhance production of EPA. Plasmid pZKSL5598 contained the following components:

TABLE 35

Description of Plasmid pZKSL5598 (SEQ ID NO: 152)

| RE Sites And Nucleotides Within SEQ ID NO: 152 | Description Of Fragment And Chimeric Gene Components |
|---|---|
| AscI/BsiWI (10409-9573) | 794 bp 5' part of Yarrowia Lys5 gene (GenBank Accession No. M34929) |
| SphI/PacI (13804-13117) | 687 bp 3' part of Yarrowia Lys5 gene (GenBank Accession No. M34929) |
| BsiWI/SwaI (7150-9573) | NT::I.D5S::Lip1, comprising:<br>NT: YAT1 promoter (SEQ ID NO: 180)<br>I.Δ5S: codon-optimized Δ5 desaturase gene (SEQ ID NO: 10), derived from *Isochrysis galbana* (WO 2002/081668)<br>Lip1: Lip1 terminator sequence of Yarrowia Lip1 gene (GenBank Accession No. Z50020) |
| SalI/BsiWI (4537-7150) | GPAT::MAΔ5::Pex20, comprising:<br>GPAT: GPAT promoter (SEQ ID NO: 179)<br>MAΔ5: *Mortierella alpina* Δ5 desaturase gene (SEQ ID NO: 6) (GenBank Accession No. AF067654)<br>Pex20: Pex20 terminator sequence from Yarrowia Pex20 gene (GenBank Accession No. AF054613) |
| SwaI/PmeI (2381-348) | FBAINm::IgD9e::OCT, comprising:<br>FBAINm: FBAINm promoter (SEQ ID NO: 178)<br>IgD9e: codon-optimized Δ9 elongase gene (SEQ ID NO: 51), derived from *I. galbana*<br>OCT: OCT terminator sequence of Yarrowia OCT gene (GenBank Accession No. X69988) |
| ClaI/PacI (1-13804) | GPD::D8SF::Pex16, comprising:<br>GPD: GPD promoter (SEQ ID NO: 173)<br>D8SF: codon-optimized Δ8 desaturase gene (SEQ ID NO: 61), derived from *Euglena gracilis* (GenBank Accession No. AF139720)<br>Pex16: Pex16 terminator sequence of Yarrowia Pex16 gene (GenBank Accession No. U75433) |
| SalII/PmeI (4537-2417) | Yarrowia Leu2 gene (GenBank Accession No. AF260230) |

Plasmid pZKSL5598 was digested with AscI/SphI, and then used to transform strain Y2189 according to the General Methods. Following transformation, the cells were plated onto MMLys plates and maintained at 30° C. for 2 to 3 days. The individual colonies grown on MMLys plates from each transformation were picked and streaked onto MM and MMLys plates. Those colonies that could grow on MMLys plates but not on MM plates were selected as Lys⁻ strains. Single colonies of Lys⁻ strains were then inoculated into liquid MMLys media at 30° C. and shaken at 250 rpm/min for 2 days. The cells were collected by centrifugation, lipids were extracted, and fatty acid methyl esters were prepared by transesterification, and subsequently analyzed with a Hewlett-Packard 6890 GC.

GC analyses showed increased production of EPA in pZKSL5598 transformants. Among the 96 selected Lys-transformants of Y2189 with pZKSL5598, most strains produced between 4-8% EPA of total lipids. There were two strains (i.e., #34 and #77, designated herein as "Y2201" and "Y2203") that produced about 9% and 8.7% EPA of total lipids, respectively.

Example 18

The ω-3 Δ9 Elongase/Δ8 Desaturase Pathway: Generation of Strain L116 to Produce About 1.3% EPA in *Yarrowia lipolytica*

The present Example describes the construction of strain L116, derived from *Yarrowia lipolytica* ATCC #20362, capable of producing about 1.3% EPA relative to the total lipids (FIG. 5). This strain was engineered to express the ω-3 Δ9 elongase/Δ8 desaturase pathway; thus, analysis of the complete lipid profiles of strain L116 indicating no GLA co-synthesis in the final EPA-containing oil was expected.

The development of strain L116 required the construction of strain L98 (producing ALA), strain L103 (producing increased ALA) and strain L115 (producing about 4% ETA). Additionally, strain L116 required the synthesis and expression of a novel bifunctional Δ5/Δ6 desaturase derived from *Danio rerio* (GenBank Accession No. BC068224), characterized herein as having only (or strong) ω-3 specificity. It is contempalted that high concentrations of EPA could readily be produced via the ω-3 Δ9 elongase/Δ8 desaturase pathway demonstrated herein, with additional genetic engineering efforts aimed toward optimization of the expressed pathway as taught in the present invention.

Creation of Lox P::Ura3/HPT::LoxP Integration Constructs and a Cre-SU Replicating Plasmid for Recyclable Selection The strategy utilized to introduce multiple copies of a Δ15 desaturase into *Yarrowia lipolytica* relied on a recyclable selection marker and a site-specific recombination system (i.e., Cre/Lox). Briefly, the target gene (i.e., (i.e., *Fusarium moniliforme* Δ15 desaturase [SEQ ID NO:39]) was cloned adjacent to selection markers (e.g., Ura3 and hygromycin phosphotransferase [HPT]) and only the selection markers were flanked by Lox P sites in the integration construct. Following transformation and selection of the transformants, the selection markers (i.e., Ura3 and hygromycin resistance) were excised from the chromosome by the introduction of a replicating plasmid carrying a sulfonylurea resistance (SU) gene and Cre recombinase gene. Following loss of the Ura3 and hygromycin selection markers, the Cre plasmid was cured. The cured strain was thus available for another round of transformation.

More specifically, plasmid pY72 (FIG. 17A, SEQ ID NO:390) was an integration construct comprising one copy of the *Fusarium moniliforme* Δ15 desaturase and a Ura3/HPT selection marker flanked by Lox P sites. Construct pY72 contained the following components:

TABLE 36

Description of Plasmid pY72 (SEQ ID NO: 390)

| RE Sites And Nucleotides Within SEQ ID NO: 390 | Description Of Fragment And Chimeric Gene Components |
|---|---|
| 6763-7643 | 881 bp 5' part of Yarrowia Lip1 gene (GenBank Accession No. Z50020) |
| 9422-10184 | 763 bp 3' part of Yarrowia Lip1 gene (GenBank Accession No. Z50020) |
| SwaI/SbfI (16-2522) | FBAIN::FmD15:Lip2, comprising:<br>FBAIN: FBAIN promoter (SEQ ID NO: 177)<br>FmD15: *Fusarium moniliforme* Δ15 desaturase gene (SEQ ID NO: 39)<br>Lip2: Lip2 terminator sequence from Yarrowia Lip2 gene (GenBank Accession No. AJ012632) |
| 2531-2564 | LoxP sequence (SEQ ID NO: 407) |
| 2566-4184 | Yarrowia Ura3 gene (GenBank Accession No. AJ306421) |
| 4198-5861 | TEF::HPT::XPR, comprising:<br>TEF: TEF promoter (GenBank Accession No. AF054508)<br>HPT: *Escherichia coli* hygromycin phosphotransferase coding region, conveying hygromycin resistance (Kaster, K. R., et al., Nucleic Acids Res. 11: 6895–6911 (1983))<br>XPR: ~100 bp of the 3' region of the Yarrowia Xpr gene (GenBank Accession No. M17741) |
| 5862-5895 | LoxP sequence (SEQ ID NO: 407) |

Similarly, plasmid pY80 (FIG. 17B, SEQ ID NO:391) was used to create an integration construct comprising two copies of the *Fusarium moniliforme* Δ15 desaturase and a Ura3/HPT selection marker flanked by Lox P sites. Using primers 436 and 437 (SEQ ID NOs:408 and 409), PCR was used to amplify the Pac I/Fse I fragment comprising GPD::Fm1::XPR2 from the 8878 bp plasmid, pY34 (WO 2005/047480). This Pac I/Fse I fragment was cloned into Pac I/Fse 1-digested vector pY72 by in-fusion cloning (Clontech Laboratories, Inc., Mountain View, Calif.) and transformed into XL-2 Ultra competent cells (BRL, Bethesda, Md.). Of the ten positive transformants identified by miniprep analysis following Pac I/Fse I digestion, only clones #3 and #4 were correct. One of the correct clones was designated "pY80". Thus, construct pY80 contained the following components:

TABLE 37

Description of Plasmid pY80 (SEQ ID NO: 391)

| RE Sites And Nucleotides Within SEQ ID NO: 391 | Description Of Fragment And Chimeric Gene Components |
|---|---|
| PacI/FseI (4-2375) | GPD::FmD15:XPR, comprising: GPD: GPD promoter (SEQ ID NO: 173) FmD15: *Fusarium moniliforme* Δ15 desaturase gene (SEQ ID NO: 39) XPR: ~100 bp of the 3' region of the *Yarrowia* Xpr gene (GenBank Accession No. M17741) |
| FseI/SbfI 2385-4891 | FBAIN::FmD15:Lip2: as described for pY72 (supra) |
| 4900-4933 | LoxP sequence (SEQ ID NO: 407) |
| 4935-6533 | *Yarrowia* Ura3 gene (GenBank Accession No. AJ306421) |
| 6567-8230 | TEF::HPT::XPR: as described for pY72 (supra) |
| 8231-8264 | LoxP sequence (SEQ ID NO: 407) |
| 8271-9079 | 809 bp 5' part of *Yarrowia* Lip1 gene (GenBank Accession No. Z50020) |
| 11791-12553 | 763 bp 3' part of *Yarrowia* Lip1 gene (GenBank Accession No. Z50020) |

Construct pY79 (FIG. 17C, SEQ ID NO:392) was a replicating plasmid carrying a sulfonylurea resistance (SU) gene (i.e., AHAS) and TEF::Cre recombinase gene. Specifically, construct pY79 contained the following components:

TABLE 38

Description of Plasmid pY79 (SEQ ID NO: 392)

| RE Sites And Nucleotides Within SEQ ID NO: 392 | Description Of Fragment And Chimeric Gene Components |
|---|---|
| 4329-7315 | *Yarrowia lipolytica* AHAS gene comprising a W497L mutation (SEQ ID NO: 292) |
| 7362-1 | TEF::Cre::XPR, comprising: TEF: TEF promoter (GenBank Accession No. AF054508) Cre: Enterobacteria phage P1 Cre gene for recombinase protein (Genbank Accession No. X03453) XPR: ~100 bp of the 3' region of the *Yarrowia* Xpr gene (GenBank Accession No. M17741) |

Generation of Strain L98, Producing ALA

Plasmid pY72 (SEQ ID NO:390) was digested with AscI/SphI, and then used to transform wild type *Yarrowia lipolytica* ATCC #20362 using a standard lithium acetate method. Following transformation, the cells were plated onto YPD+Hygromycin (250 μg/mL) plates. After 2 days, 20 transformants were picked and streaked onto fresh YPD+Hygromycin (250 μg/mL) plates and incubated at 30° C. overnight. The cells were collected by centrifugation, lipids were extracted, and fatty acid methyl esters were prepared by trans-esterification, and subsequently analyzed with a Hewlett-Packard 6890 GC.

GC analyses showed the presence of ALA in pY72 transformants, but not in the wild type *Yarrowia* control strain. The best clone produced about 27% ALA of total lipids, and displayed 80% substrate conversion.

The Ura3/HPT markers flanked by the LoxP sites in pY72 were excised from the genome by transforming the ATCC #20362/pY72 transformants with pY79 (SEQ ID NO:392, carrying the sulfonylurea (SU) resistance marker) and selecting transformants for 3 days on MM+SU (150 μg/mL) plates. The SU-resistant (SUR) transformants were restreaked on fresh MM+SU (150 μg/mL) plates for 1 day and then replica-plated onto YPD+Hygromycin (250 μg/mL) plates. All clones (except for clone #1) were sensitive to hygromycin (Hyg$^S$), thus indicating the HPT resistance gene had been successfully excised by the Cre recombinase.

Plasmid pY79 was cured from Hyg$^S$ clones #6 and #14 by growing the cells in YPD without selection at 30° C. overnight. Culture (0.1 mL) was diluted into 1 mL YPD and used to make a serial dilution, with the highest dilution being 20,000-fold. Each dilution was then plated onto a new YPD plate and incubated at 30° C. overnight. The plates were replica-plated on MM+SU (150 μg/mL) plates. All clones were SU-sensitive (SU$^S$), thus indicating that they were successfully cured of pY79. Clone #6-1 was used for additional transformations.

Specifically, using the methodology described above, plasmid pY80 (SEQ ID NO:391) was digested with AscI/SphI, and then used to transform strain #6-1. Following selection on YPD+Hygromycin (250 μg/mL) plates, GC analysis of total lipids, transformation with plasmid pY79 (SEQ ID NO:392), identification of SU$^R$ and Hyg$^S$ clones, and curing of plasmid pY79, strain #1 was identified. This strain thereby carried 3 copies of FmΔ15 and had 96.1% substrate conversion of LA to ALA.

Strain #1 was subjected to transformation with pY80 and subsequently pY79, as described above. This resulted in creation of strain L98, possessing 5 copies of FmΔ15; however, the Δ15 desaturation in this strain was not significantly improved relative to strain #1 (possessing 3 copies of FmΔ15), as a result of insufficient substrate (i.e., LA).

Generation of Strain L103, Producing Increased ALA

Plasmid pY86 (FIG. 17D, SEQ ID NO:393) was an integration construct comprising one copy of the *Fusarium moniliforme* Δ12 desaturase and a Ura3/HPT selection marker flanked by Lox P sites. Specifically, pY86 contained the following components:

TABLE 39

Description of Plasmid pY86 (SEQ ID NO: 393)

| RE Sites And Nucleotides Within SEQ ID NO: 393 | Description Of Fragment And Chimeric Gene Components |
|---|---|
| 3399-4207 | 809 bp 5' part of *Yarrowia* Lip1 gene (GenBank Accession No. Z50020) |
| 6919-7681 | 763 bp 3' part of *Yarrowia* Lip1 gene (GenBank Accession No. Z50020) |

TABLE 39-continued

Description of Plasmid pY86 (SEQ ID NO: 393)

| RE Sites And Nucleotides Within SEQ ID NO: 393 | Description Of Fragment And Chimeric Gene Components |
|---|---|
| 28-61 | LoxP sequence (SEQ ID NO: 407) |
| 63-1681 | *Yarrowia* Ura3 gene (GenBank Accession No. AJ306421) |
| 1695-3358 | TEF::HPT::XPR, comprising:<br>TEF: TEF promoter (GenBank Accession No. AF054508)<br>HPT: *Escherichia coli* hygromycin phosphotransferase coding region, conveying hygromycin resistance (Kaster, K. R., et al., Nucleic Acids Res. 11: 6895–6911 (1983))<br>XPR: ~100 bp of the 3' region of the *Yarrowia* Xpr gene (GenBank Accession No. M17741) |
| 3359-3392 | LoxP sequence (SEQ ID NO: 407) |
| PacI/FseI (7690-7) | FBAIN::FmD12::Lip2, comprising:<br>FBAIN: FBAIN promoter (SEQ ID NO: 177)<br>FmD12: *Fusarium moniliforme* Δ12 desaturase gene (SEQ ID NO: 27)<br>Lip2: Lip2 terminator sequence from *Yarrowia* Lip2 gene (GenBank Accession No. AJ012632) |

Using the methodology described above, plasmid pY86 was digested with AscI/SphI, and then used to transform strain L98. Following selection on YPD+Hygromycin (250 μg/mL) plates, GC analysis of total lipids, transformation with plasmid pY79 (SEQ ID NO:392) and identification of SU$^R$ and Hyg$^S$ clones, strain L103 was identified. This strain thereby carried 5 copies of FmΔ15, 1 copy of FmΔ12 and was Ura3−. Relative to strain L98, the quantity of 18:1 in strain L103 (as a percent of total fatty acids) was reduced from 42% to about 10%, the quantity of 18:2 in strain L103 (as a percent of total fatty acids) was increased from 2% to about 10%, and the quantity of ALA in strain L103 (as a percent of total fatty acids) was increased from 22% to 47%.

Generation of Strain L115 to Produce About 4% ETA of Total Lipids

Plasmid pY94 (FIG. 18A, SEQ ID NO:394) was an integration construct comprising one copy of a Δ8 desaturase, one copy of a Δ9 elongase, and a Ura3 selection marker flanked by Lox P sites. This plasmid contained the following components:

TABLE 40

Description of Plasmid pY94 (SEQ ID NO: 394)

| RE Sites And Nucleotides Within SEQ ID NO: 394 | Description Of Fragment And Chimeric Gene Components |
|---|---|
| PacI/SwaI (1-2587) | FBAIN::D8:Pex16, comprising:<br>FBAIN: FBAIN promoter (SEQ ID NO: 177)<br>D8: codon-optimized Δ8 desaturase gene (SEQ ID NO: 61), derived from *Euglena gracilis* (GenBank Accession No. AF139720)<br>Pex16: Pex16 terminator sequence of *Yarrowia* Pex16 gene (GenBank Accession No. U75433) |
| 2592-4684 | GPAT::D9E::Lip1, comprising:<br>GPAT: GPAT promoter (SEQ ID NO: 179)<br>D9E: codon-optimized Δ9 elongase gene (SEQ ID NO: 51), derived from *I. galbana*<br>Lip1: Lip1 terminator sequence of *Yarrowia* Lip1 gene (GenBank Accession No. Z50020) |
| 4714-4747 | LoxP sequence (SEQ ID NO: 407) |
| 4761-6378 | *Yarrowia* Ura3 gene (GenBank Accession No. AJ306421) |
| 6380-6413 | LoxP sequence (SEQ ID NO: 407) |
| 6470-7253 | 784 bp 5' part of *Yarrowia* Ura3 gene (GenBank Accession No. AJ306421) |
| 9965-10480 | 516 bp 3' part of *Yarrowia* Ura3 gene (GenBank Accession No. AJ306421) |

Plasmid pY94 was transformed into strain L103, using a standard lithium acetate method. Following transformation, the cells were plated onto MM plates and maintained for 3 days. Twenty-two colonies were then picked and streaked onto fresh MM plates and grown at 30° C. overnight. The cells were collected by centrifugation, lipids were extracted, and fatty acid methyl esters were prepared by trans-esterification, and subsequently analyzed with a Hewlett-Packard 6890 GC. Clone #8 (herein designated as strain L104) possessed the highest Δ9 elongase and Δ8 desaturase percent substrate conversions.

The Ura3 marker flanked by the LoxP sites in pY94 was excised from the genome by transforming log phase cells of strain L104 with 1 μl (~0.5 μg/ml) pY79 (SEQ ID NO:392) and selecting transformants for 4 days on MMU+SU (100 μg/mL) plates. Twelve SU$^R$ transformants were restreaked on fresh MM and MMU plates for 2 days. All clones (except one) were URA auxotrophic (i.e., Ura$^S$), thus indicating the Ura3 resistance gene had been successfully excised by the Cre recombinase.

Plasmid pY79 was cured from one URA auxotroph by making 1:10,000 to 1:50,000 dilutions in MMU from one-third of a loopful of cells. Dilutions (100 μl/plate) were plated onto YPD plates and incubated at 30° C. for 2 days. Eight colonies were picked from a YPD plate and streaked onto MMU plates and MMU+SU plates and incubated at 30° C. for 24 hours. All clones were SU-sensitive (SU$^S$), thus indicating that they were successfully cured of pY79. One of these was designated L111 and thereby carried 5 copies of FmΔ15, 1 copy of FmΔ12, 1 copy of a Δ8 desaturase, 1 copy of a Δ9 elongase and was Ura3−.

Strain L115 (possessing 5 copies of FmΔ15, 1 copy of FmΔ12, 2 copies of a Δ8 desaturase, 2 copies of a Δ9 elongase and characterized as Ura3−) was created by transforming strain L111 with pY94 (SEQ ID NO:394), using the methodology described above. GC analysis showed that strain L115 produced about 4% ETA of total lipids (complete lipid profile, infra).

Generation of Strain L116 to Produce About 1.3% EPA of Total Lipids

The *Danio rerio* desaturase identified as GenBank Accession No. AF309556 (Hastings et al., PNAS 98(25):14304-14309 (2001)) was reported to show bifunctional Δ6 and Δ5 desaturase activity in *Saccharomyces cerevisiae*, with: (1) a distinct preference for ω-3 substrates as compared to ω-6 substrates; and, (2) a slightly higher Δ6 desaturase activity relative to Δ5 desaturase activity.

The Applicants identified GenBank Accession No. BC068224 as a homolog of GenBank Accession No. AF309556 that differed by a 1 bp (T) deletion at position 984 of the ORF (resulting in a null mutation) and a 1 bp change ('G' to 'A') at position 1171 (resulting in a 'V' to 'M' amino acid change).

A mutant protein was then created (identified herein as "Drd6/d5(M)"; SEQ ID NO:373) identical to GenBank Accession No. AF309556 (identified herein as "Drd6/d5(V)"; SEQ ID NO:370), with the exception of the V1171M mutation. Specifically, two overlapping fragments were first amplified from GenBank Accession No. BC068224 cDNA phagemid using primer pairs 475 and 477 (SEQ ID NOs:410 and 411) and 478 and 476 (SEQ ID NOs:412 and 413) [wherein primers 477 and 478 carried the "missing T"]. Then, the entire Drd6/d5(M) ORF was amplified using primers 475 and 476 and the two overlapping fragments as template. The ORF was placed in a replicating plasmid, containing the following components, and identified herein as plasmid "pY91M" (FIG. 18B):

TABLE 41

Description of Plasmid pY91M (SEQ ID NO: 395)

| RE Sites And Nucleotides Within SEQ ID NO: 395 | Description Of Fragment And Chimeric Gene Components |
|---|---|
| 2866-4170 | ARS18 sequence (GenBank Accession No. A17608) |
| 4216-5703 | *Yarrowia* Ura3 gene (GenBank Accession No. AJ306421) |
| SalI/BsiWI (5705-8423) | FBAIN::DrD6:Pex20, comprising: FBAIN: FBAIN promoter (SEQ ID NO: 177) DrD6: Drd6/d5(M) gene (SEQ ID NO: 372), derived from *Danio rerio* Δ5/Δ6 desaturase (GenBank Accession No. BC068224) Pex20: Pex20 terminator sequence of *Yarrowia* Pex20 gene (GenBank Accession No. AF054613) |

Plasmid pY91V was created from plasmid pY91M by site-specific mutagenesis using a QuikChange® II Site-Directed Mutagenesis Kit, (Stratagene, Catalog #200523) and primers 505 and 506 (SEQ ID NOs:414 and 127). pY91V was identical to pY91M, except for a single bp change that resulted in the M to V amino acid mutation described above.

Plasmids pY91M and pY91V, as well as an empty vector serving as the control, were transformed into log phase cells of strain L115, respectively, using a standard lithium acetate method. Following transformation, the cells were plated onto MM plates and maintained for 3 days. Colonies were then picked and streaked onto fresh MM plates and grown at 30° C. overnight. One-third of a loopful of cells from each clone were inoculated into 3 mL MM and grown in a shaker at 30° C. for 24 hrs. Alternatively, cells were grown for 24 hours in MM and then cultured for 3 days in HGM. All cells were harvested and their fatty acid composition was analyzed by GC, as described previously.

The complete lipid profiles of strain L115 (expressing an ω-3 Δ9 elongase/Δ8 desaturase pathway as a result of FmΔ15, FmΔ12, Δ8 desaturase and Δ9 elongase chimeric genes) transformed with empty vector (control), pY91M and pY91V, are shown below in Table 42. Fatty acids are identified as 16:0, 16:1, 17:1, 18:0, 18:1 (oleic acid), 18:2 (LA), GLA, 20:2 (EDA), DGLA, ARA, ALA, STA, 20:3 (ETrA), ETA and EPA; and the composition of each is presented as a % of the total fatty acids. Three separate experiments were performed, identified as Experiment No. 1, 2 and 3 in the column labeled "Exp. No.". Additionally, the Δ6 and Δ5 percent substrate conversions for each strain are reported, with respect to activity utilizing both ω-6 and ω-3 substrates (Table 43).

TABLE 42

Lipid Profile Of *Yarrowia lipolytica* Strain L115 Transformed With pY91M And pY91V

| Exp. No. | Strain | Time/Medium | 16:0% | 16:1% | 18:0% | 18:1% | 18:2% | GLA % | 20:2% | DGLA % | ARA % | ALA % | STA % | 20:3% | ETA % | EPA % |
|---|---|---|---|---|---|---|---|---|---|---|---|---|---|---|---|---|
| 1 | L115 + pY91M (clone 11) | 1D MM | 16 | 10 | 2 | 8 | 11 | 0.0 | 0 | 1 | 0.0 | 40 | 3.2 | 1.1 | 4.2 | 1.3 |
| 1 | L115 + control | 1D MM | 18 | 9 | 5 | 18 | 12 | 0.0 | 0 | 1 | 0.0 | 31 | 0.0 | 0.9 | 3.9 | 0.0 |
| 2 | L115 + pY91M (clone 11) | 1D MM/ 3D HGM | 14 | 11 | 6 | 26 | 15 | 0.5 | 1 | 2 | 0.0 | 18 | 2.4 | 1.0 | 2.9 | 0.6 |
| 2 | L115 + control | 1D MM/ 3D HGM | 13 | 11 | 6 | 26 | 15 | 0.2 | 1 | 2 | 0.0 | 20 | 0.0 | 1.5 | 4.1 | 0.2 |
| 3 | L115 + pY91V (clone 10) | 1D MM | 17 | 8 | 6 | 20 | 15 | 0.0 | 0 | 1 | 0.0 | 27 | 0.0 | 0.9 | 3.9 | 0.0 |
| 3 | L115 + pY91M (clone 11) | 1D MM | 17 | 9 | 3 | 11 | 11 | 0.0 | 0 | 0 | 0.0 | 38 | 2.6 | 1.1 | 4.4 | 1.2 |
| 3 | L115 + control | 1D MM | 17 | 8 | 6 | 21 | 13 | 0.0 | 0 | 1 | 0.0 | 28 | 0.0 | 1.1 | 4.0 | 0.0 |

*The L115/pY91M transformant identified as clone #11 was designated as Yarrowia lipolytica strain "L116".

TABLE 43

Percent Substrate Conversion By Drd6/d5M And Drd6/d5V

| Exp. No. | Strain | ω-3/ω-6 | Δ6 (ω-6) | Δ6 (ω-3) | Δ5 (ω-6) | Δ5 (ω-3) |
|---|---|---|---|---|---|---|
| 1 | L115 + pY91M (clone 11) | 4.2 | 0 | 7 | 0 | 23 |
| 1 | L115 + control | 2.8 | 0 | 0 | 0 | 0 |
| 2 | L115 + pY91M (clone 11) | 1.3 | 3 | 12 | 0 | 16 |
| 2 | L115 + control | 1.5 | 1 | 0 | 0 | 5 |
| 3 | L115 + pY91V (clone 10) | 2.0 | 0 | 0 | 0 | 0 |
| 3 | L115 + pY91M (clone 11) | 4.4 | 0 | 7 | 0 | 21 |
| 3 | L115 + control | 2.5 | 0 | 0 | 0 | 0 |

As demonstrated in the results above, expression of Drd6/d5(M) in *Yarrowia lipolytica* (i.e., strain L115+pY91M) did indeed yield a bifunctional enzyme having both Δ6 and Δ5 desaturase activities, with a higher % substrate conversion for Δ5 desaturase activity (i.e., ETA to EPA) than Δ6 desaturase activity (i.e., ALA to STA) and with much higher ω-3 substrate preference for both Δ6 and Δ5 desaturase activities. Unexpectedly, preliminary results with Drd6/d5(V) (i.e., strain L115+pY91V) did not show Δ6 or Δ5 activity, while Drd6/d5(M) lacked Δ5 activity on ω-6 substrate. Thus, Drd6/d5(M) had different characteristics than Drd6/d5(V). The differences in activity of Drd6/d5(V) from published work are likely to be related to the different host organism in which the protein was expressed and/or the origin of the substrate (i.e., substrate feeding [Hastings et al., supra] or substrate biosynthesis [demonstrated herein]).

To better understand the substrate specificities of Drd6/d5(M) and Drd6/d5(V), the FBAIN::Drd6/d5(M)::Pex20 and FBAIN::Drd6/d5(V)::Pex20 chimeric genes were transferred into a *Yarrowia* replicating plasmid with LEU selection, thereby resulting in creation of plasmids pY102(M) and pY102(V), respectively. These plasmids were then transformed into strain Q-d12D, a *Y. lipolytica* strain comprising a Δ12 desaturase knockout (WO 2004/104167). The transformants were grown for 1 day in MM in the presence of 0.5 mM of either LA, ALA, ETrA [20:3 (11,14,17)], EDA, DGLA or ETA and the % substrate conversion was tested. Results are shown below in Table 44:

TABLE 44

Percent Substrate Conversion By Drd6/d5(M) And Drd6/d5(V) In Transformant *Yarrowia* Strain Q-d12D

| | | Substrate conversion (%) | | | | | |
|---|---|---|---|---|---|---|---|
| Plasmid | Fatty Acid | Δ6 (ω-6) | Δ6 (ω-3) | Δ8 (ω-6) | Δ8 (ω-3) | Δ5 (ω-6) | Δ5 (ω-3) |
| pY102(M) | LA | 17 | — | — | — | — | — |
| pY102(V) | LA | 4 | — | — | — | — | — |
| pY102(M) | ALA | — | 24 | — | — | — | — |
| pY102(V) | ALA | — | 6 | — | — | — | — |
| pY102(M) | EDA | 17 | — | 0 | — | — | — |
| pY102(V) | EDA | 0 | — | 0 | — | — | — |
| pY102(M) | ETrA | — | 30 | — | 13 | — | — |
| pY102(V) | ETrA | — | 9 | — | 0 | — | — |
| pY102(M) | DGLA | — | — | — | — | 12 | — |
| pY102(V) | DGLA | — | — | — | — | 0 | — |
| pY102(M) | ETA | — | — | — | — | — | 34 |
| pY102(V) | ETA | — | — | — | — | — | 0 |

The results showed that the novel Drd6/d5(M) desaturase had (as compared to the published Drd6/d5(V) desaturase): (1) a higher % substrate conversion on all substrates tested; (2) a higher selectivity towards (0-3 fatty acids as compared to ω-6 fatty acids [although there was no Δ5 activity in Drd6/d5(V) with either ω-3 or ω-6 substrate]; and, (3) an unexpected Δ8 desaturase activity.

The differences in % substrate conversions between the Q-d12D transformants versus L115 transformants were likely the result of substrate feeding. Since Drd6/d5 has been reported to act on an acyl-CoA substrate, the desaturase activities can differ as a result of fatty acid feeding or de novo synthesis by the *Yarrowia* host. Another unexpected observation was that Drd6/d5(M) converted ETrA [20:3 (11, 14, 17)] into ETA but did not convert EDA [20:2 (11, 14)] into DGLA; i.e., the protein had Δ8 desaturase activity only on the ω-3 substrate.

It is clear that this Drd6/d5(M) desaturase has characteristics that could provide unique advantages for pathway engineering when expressed in *Yarrowia lipolytica*.

Example 19

Preparation of *Mortierella Alpina* Genomic DNA and cDNA

The present Example describes the preparation of genomic DNA and cDNA from *Mortierella alpina* (ATCC #16266). This enabled isolation of the *M. alpina* LPMT2, DGAT1, DGAT2, GPAT and ELO3, as described in Examples 20, 21, 22, 23 and 24, respectively.

Preparation of Genomic DNA from *Mortierella Alpina*

Genomic DNA was isolated from *Mortierella* alpina (ATCC #16266) using a QiaPrep Spin Miniprep Kit (Qiagen, Catalog #627106). Cells grown on a YPD agar plate (2% Bacto-yeast extract, 3% Bacto-peptone, 2% glucose, 2.5% bacto-agar) were scraped off and resuspended in 1.2 mL of kit buffer P1. The resuspended cells were placed in two 2.0 mL screw cap tubes, each containing 0.6 mL glass beads (0.5 mm diameter). The cells were homogenized at the HOMOGENIZE setting on a Biospec (Bartlesville, Okla.) mini bead beater for 2 min. The tubes were then centrifuged at 14,000 rpm in an Eppendorf microfuge for 2 min. The supernatant (0.75 mL) was transferred to three 1.5 mL microfuge tubes. Equal volumes of kit buffer P2 were added to each tube. After mixing the tubes by inversion three times, 0.35 mL of buffer N3 was added to each tube. The contents of each tube were again mixed by inversion for a total of five times. The mixture was centrifuged at 14,000 rpm in an Eppendorf microfuge for 5 min. The supernatant from each tube was transferred individually into 3 separate kit spin columns. The columns were then subjected to the following steps: centrifugation (1 min at 14,000 rpm), wash once with buffer PE, centrifugation (1 min at 14,000 rpm), and then a final centrifugation (1 min at 14,000 rpm). Buffer EB (50 µl) was added to each column and let stand for 1 min. The genomic DNA was then eluted by centrifugation at 14,000 rpm for 1 min.

Preparation of cDNA from *Mortierella Alpina* cDNA of *Mortierella* alpina was prepared using the BD-Clontech Creator Smart® cDNA library kit (Mississauga, ON, Canada), according to the manufacturer's protocol.

Specifically, *M. alpina* strain ATCC #16266 was grown in 60 mL YPD medium (2% Bacto-yeast extract, 3% Bactor-peptone, 2% glucose) for 3 days at 23° C. Cells were pelleted by centrifugation at 3750 rpm in a Beckman GH3.8 rotor for 10 min and resuspended in 6×0.6 mL Trizole reagent (Invitrogen). Resuspended cells were transferred to six 2 mL screw cap tubes each containing 0.6 mL of 0.5 mm glass beads. The cells were homogenized at the HOMOGENIZE setting on a Biospec mini bead beater for 2 min. The tubes were briefly spun to settle the beads. Liquid was transferred to 4 fresh 1.5 mL microfuge tubes and 0.2 mL chloroform/isoamyl alcohol (24:1) was added to each tube. The tubes were shaken by hand for 1 min and let stand for 3 min. The tubes were then spun at 14,000 rpm for 10 min at 4° C. The upper layer was transferred to 4 new tubes. Isopropyl alcohol (0.5 mL) was added to each tube. Tubes were incubated at room temperature for 15 min, followed by centrifugation at 14,000 rpm and 4° C. for 10 min. The pellets were washed with 1 mL each of 75% ethanol, made with RNase-free water and air-dried. The total RNA sample was then redissolved in 500 µl of water, and the amount of RNA was measured by A260 nm using 1:50 diluted RNA sample. A total of 3.14 mg RNA was obtained.

This total RNA sample was further purified with the Qiagen RNeasy total RNA Midi kit following the manufacturer's protocol. Thus, the total RNA sample was diluted to 2 mL and mixed with 8 mL of buffer RLT with 80 µl of β-mercaptoethanol and 5.6 mL 100% ethanol. The sample was divided into 4 portions and loaded onto 4 RNeasy midid columns. The columns were then centrifuged for 5 min at 4500×g. To wash the columns, 2 mL of buffer RPE was loaded and the columns centrifuged for 2 min at 4500×g. The washing step was repeated once, except that the centrifugation time was extended to 5 min. Total RNA was eluted by applying 250 µl of RNase free water to each column, waiting for 1 min and centrifuging at 4500×g for 3 min.

PolyA(+)RNA was then isolated from the above total RNA sample, following the protocol of Amersham Biosciences' mRNA Purification Kit. Briefly, 2 oligo-dT-cellulose columns were used. The columns were washed twice with 1 mL each of high salt buffer. The total RNA sample from the previous step was diluted to 2 mL total volume and adjusted to 10 mM Tris/HCl, pH 8.0, 1 mM EDTA. The sample was heated at 65° C. for 5 min, then placed on ice. Sample buffer (0.4 mL) was added and the sample was then loaded onto the two oligo-dT-cellulose columns under gravity feed. The columns were centrifuged at 350×g for 2 min, washed 2× with 0.25 mL each of high salt buffer, each time followed by centrifugation at 350×g for 2 min. The columns were further washed 3 times with low salt buffer, following the same centrifugation routine. Poly(A)+ RNA was eluted by washing the column 4 times with 0.25 mL each of elution buffer preheated to 65° C., followed by the same centrifugation procedure. The entire purification process was repeated once. Purified poly(A)+ RNA was obtained with a concentration of 30.4 ng/µl.

cDNA was generated, using the LD-PCR method specified by BD-Clontech and 0.1 µg of polyA(+) RNA sample. Specifically, for 1$^{st}$ strand cDNA synthesis, 3 µl of the poly(A)+ RNA sample was mixed with 1 µl of SMART IV oligo nucleotide (SEQ ID NO:293) and 1 µl of CDSIII/3' PCR primer (SEQ ID NO:294). The mixture was heated at 72° C. for 2 min and cooled on ice for 2 min. To the tube was added the following: 2 µl first strand buffer, 1 µl 20 mM DTT, 1 µl 10 mM dNTP mix and 1 µl Powerscript reverse transcriptase. The mixture was incubated at 42° C. for 1 hr and cooled on ice.

The 1$^{st}$ strand cDNA synthesis mixture was used as template for the PCR reaction. Specifically, the reaction mixture contained the following: 2 µl of the 1$^{st}$ strand cDNA mixture, 2 µl 5'-PCR primer (SEQ ID NO:295), 2 µl CDSIII/3'-PCR primer (SEQ ID NO:294), 80 µl water, 10 µl×10 Advantage 2 PCR buffer, 2 µl 50×dNTP mix and 2 µl 50× Advantage 2 polymerase mix. The thermocycler conditions were set for 95° C. for 20 sec, followed by 14-20 cycles of 95° C. for 5 sec and 68° C. for 6 min on a GenAmp 9600 instrument. PCR product was quantitated by agarose gel electrophoresis and ethidium bromide staining.

Seventy-five µl of the above PCR products (cDNA) were mixed with 311 of 20 µg/µl proteinase K supplied with the kit. The mixture was incubated at 45° C. for 20 min, then 75 µl of water was added and the mixture was extracted with 150 µl phenol:chloroform:isoamyl alcohol mixture (25:24:1). The aqueous phase was further extracted with 150 µl chloroform:isoamyl alcohol (25:1). The aqueous phase was then mixed with 15 µl of 3 M sodium acetate, 2 µl of 20 µg/µl glycogen and 400 µl of 100% ethanol. The mixture was immediately centrifuged at room temperature for 20 min at 14000 rpm in a microfuge. The pellet was washed once with 150 µl of 80% ethanol, air dried and dissolved in 79 µl of water.

Dissolved cDNA was subsequently digested with SfiI (79 µl of the cDNA was mixed with 10 µl of 10×SfiI buffer, 10 µl of SfiI enzyme and 1 µl of 100×BSA and the mixture was incubated at 50° C. for 2 hrs). Xylene cyanol dye (2 µl of 1%) was added. The mixture was then fractionated on the Chroma Spin-400 column provided with the kit, following the manufacturer's procedure exactly. Fractions collected from the column were analyzed by agarose gel electrophoresis. The first three fractions containing cDNA were pooled and cDNA precipitated with ethanol. The precipitated cDNA was redissolved in 7 µl of water, and ligated into kit-supplied PDNR-LIB.

Library Sequencing

The ligation products were used to transform *E. coli* XL-1 Blue electroporation competent cells (Stratagene). An estimated total of $2 \times 10^6$ colonies was obtained. Sequencing of the cDNA library was carried out by Agencourt Bioscience Corporation (Beverly, Mass.), using an M13 forward primer (SEQ ID NO:296).

Example 20

*Mortierella Alpina* LPAAT2 Expression Increases Percent PUFAs

The present Example describes increased EPA biosynthesis and accumulation in *Yarrowia lipolytica* strain Y2067U (Example 4) that was transformed to co-express the *M. alpina* LPMT2 (SEQ ID NOs:82 and 83). It is contempalted that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *M. alpina* LPAAT2 was similarly co-expressed therein (e.g., strains Y2088, Y2089, Y2090, Y2095, Y2096, Y2102, Y2201 and/or Y2203).

The *M. alpina* LPMT2 ORF was cloned as follows. Primers MLPAT-F and MLPAT-R (SEQ ID NOs:297 and 298) were used to amplify the LPMT2 ORF from the cDNA of *M. alpina* (Example 19) by PCR. The reaction mixture contained 1 µl of the cDNA, 1 µl each of the primers, 22 µl water and 25 µl ExTaq premix 2×Taq PCR solution (TaKaRa Bio Inc., Otsu, Shiga, 520-2193, Japan). Amplification was carried out as follows: initial denaturation at 94° C. for 150 sec, followed by 30 cycles of denaturation at 94° C. for 30 sec, annealing at 55° C. for 30 sec and elongation at 72° C. for 90 sec. A final elongation cycle at 72° C. for 10 min was carried out, followed by reaction termination at 4° C. A ~950 bp DNA fragment was obtained from the PCR reaction. It was purified using a Qiagen (Valencia, Calif.) PCR purification kit according to the manufacturer's protocol. The purified PCR product was digested with NcoI and NotI, and cloned into Nco I-Not I cut pZUF17 vector (SEQ ID NO:143; FIG. 11D), such that the gene was under the control of the *Y. lipolytica* FBAIN promoter and the PEX20-3' terminator region in the auto-replicating vector for expression in *Y. lipolytica*. Correct transformants were confirmed by restriction analysis of miniprep DNA and the resultant plasmid was designated as "pMLPAT-17" (SEQ ID NO:153).

To integrate the *M. alpina* LPAAT2 into the genome of *Yarrowia lipolytica*, plasmid pMLPAT-Int was created. Primers LPAT-Re-5-1 and LPAT-Re-5-2 (SEQ ID NOs:299 and 300) were used to amplify a 1129 bp DNA fragment, YLPAT-5' (SEQ ID NO:301), containing a 1103 bp fragment of *Y. lipolytica* genome immediately upstream of the AUG of the *Y. lipolytica* LPAAT1 (SEQ ID NO:84). The reaction mixture contained 1 µl of *Y. lipolytica* genomic DNA, 1 µl each of the primers, 22 µl water and 25 µl ExTaq premix 2×Taq PCR solution (TaKaRa). Amplification was carried out as described above. A~1130 bp DNA fragment was obtained from the PCR reaction. It was purified using Qiagen's PCR purification kit according to the manufacturer's protocol. The purified PCR product was digested with SalI and ClaI, and cloned into SalI-ClaI cut pBluescript SK (−) vector, resulting in plasmid "pYLPAT-5'".

Primers LPAT-Re-3-1 and LPAT-Re-3-2 (SEQ ID NOs:302 and 303) were then used to amplify a 938 bp fragment, YLPAT-3' (SEQ ID NO:304), containing a 903 bp fragment of *Y. lipolytica* genome immediately after the stop codon of *Y. lipolytica* LPAAT1, using the same conditions as above. The purified PCR product was digested with ClaI and XhoI, and cloned into ClaI-XhoI digested pYLPAT-5'. Correct transformants were confirmed by miniprep analysis and the resultant plasmid was designated "pYLPAT-5'-3'". pMLPAT-17 (SEQ ID NO:153) was then digested with ClaI and NotI, and a ~3.5 kb fragment containing the *Y. lipolytica* URA3 gene, the *Y. lipolytica* FBAIN promoter and the *M. alpina* LPMT2 gene was isolated using a Qiagen QiaexII gel purification kit according to the manufacturer's protocol. This fragment was cloned into ClaI-NotI digested pYLPAT-5'-3'. Correct transformants were confirmed by miniprep and restriction analysis. The resulting plasmid was named "pMLPAT-Int" (SEQ ID NO:154).

Figure 18A:
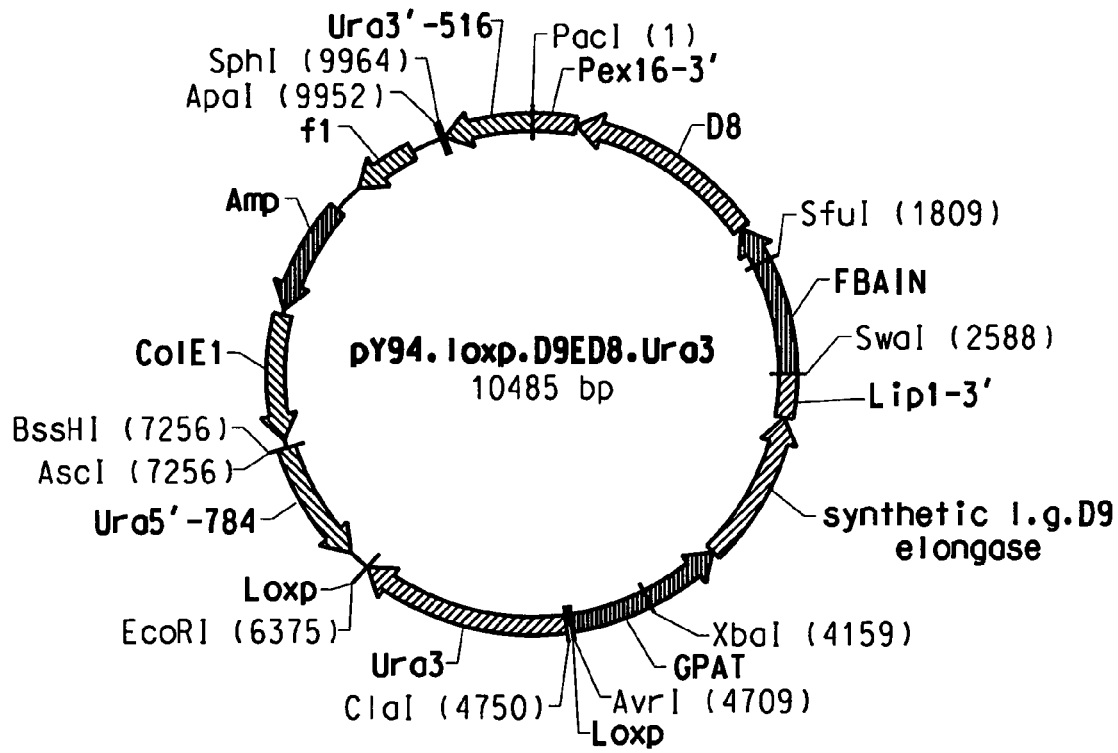
Figure 18B:
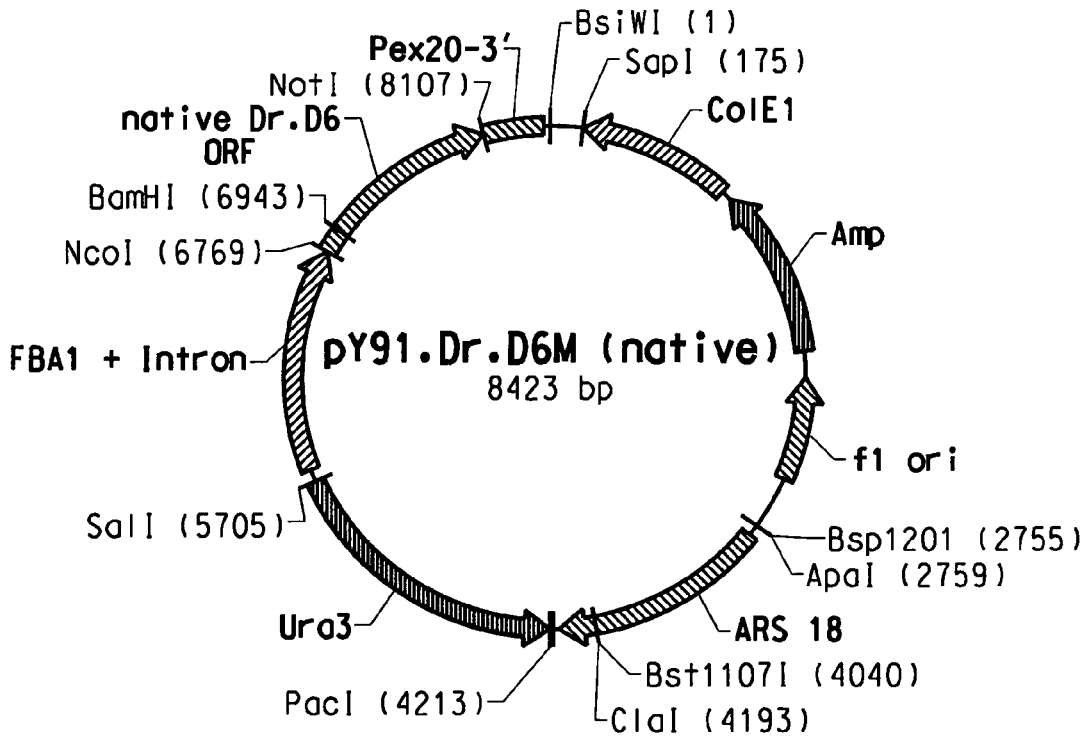
Figure 18C:
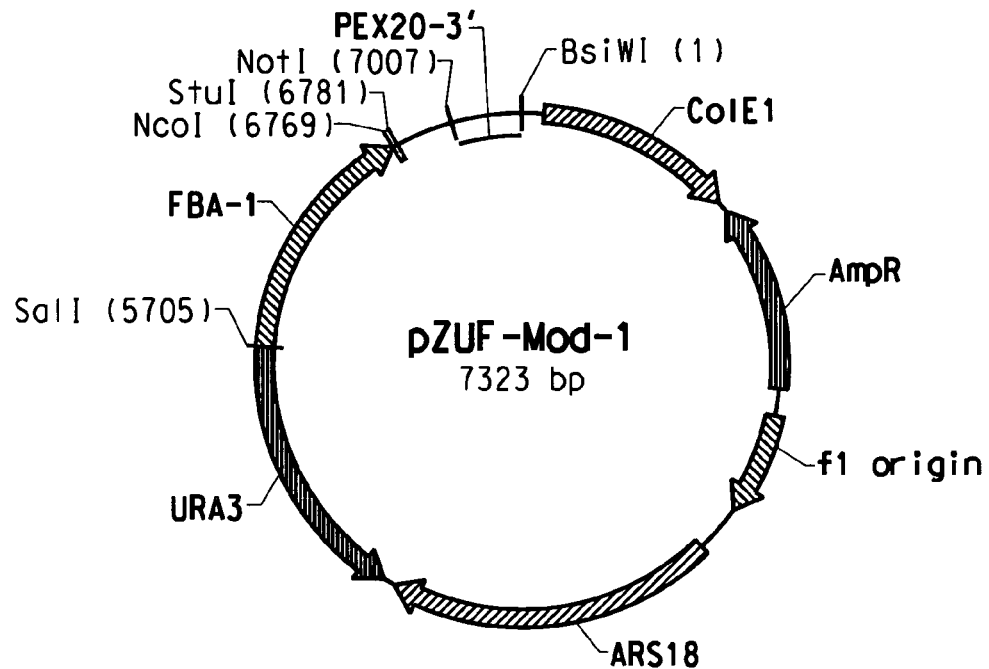
Figure 18D:
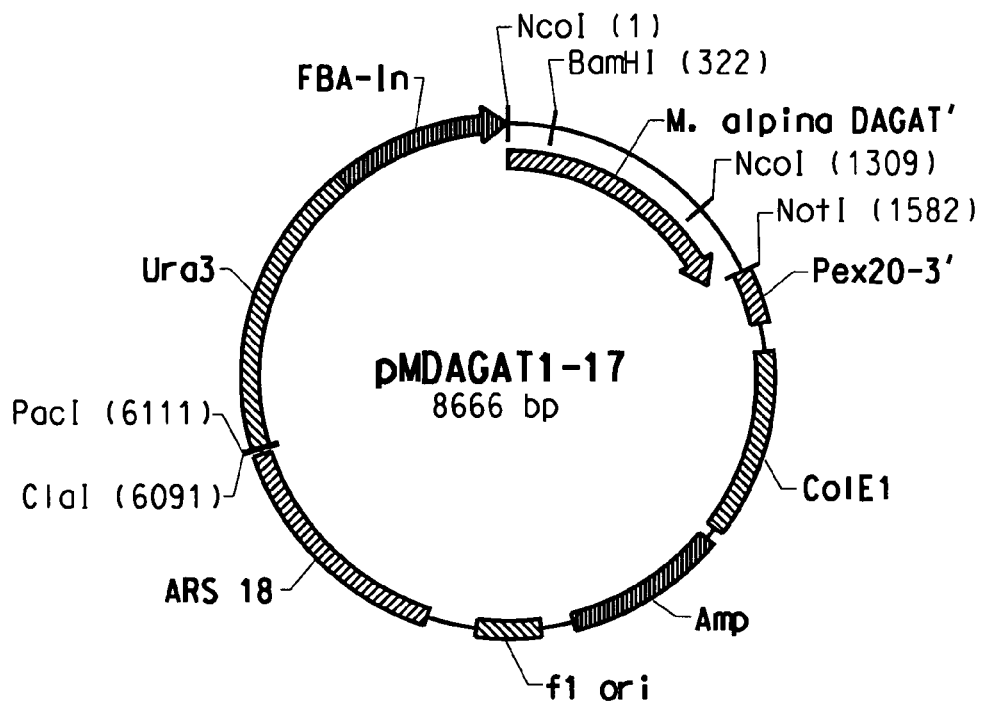

"Control" vector pZUF-MOD-1 (SEQ ID NO:155) was prepared as follows. First, primers pzuf-mod1 and pzuf-mod2 (SEQ ID NOs:305 and 306) were used to amplify a 252 bp "stuffer" DNA fragment using pDNR-LIB (ClonTech, Palo Alto, Calif.) as template. The amplified fragment was purified with a Qiagen QiaQuick PCR purification kit, digested with NcoI and NotI using standard conditions, and then purified again with a QiaQuick PCR purification kit. This fragment was ligated into similarly digested NcoI-/NotI-cut pZUF17 vector (SEQ ID NO:143; FIG. 11D) and the resulting ligation mixture was used to transform *E. coli* Top10 cells (Invitrogen). Plasmid DNA was purified from 4 resulting colonies, using a Qiagen QiaPrep Spin Miniprep kit. The purified plasmids were digested with NcoI and NotI to confirm the presence of the ~250 bp fragment. The resulting plasmid was named "pZUF-MOD-1" (SEQ ID NO:155; FIG. 18C).

*Y. lipolytica* strain Y2067U (from Example 4, producing 14% EPA of total lipids) was transformed with plasmid pMLPAT-17, plasmid pZUF-MOD-1 (control) and SpeI/XbaI digested plasmid pMLPAT-Int, individually, according to the General Methods. Transformants were grown for 2 days in synthetic MM supplemented with amino acids, followed by 4 days in HGM. The fatty acid profile of two transformants containing pZUF-MOD-1, two transformants containing pMLPAT-17, and two transformants having pMLPAT-Int integrated into the genome are shown below in the Table, based on GC analysis (as described in the General Methods). Fatty acids are identified as 18:0, 18:1 (oleic acid), 18:2 (LA), GLA, DGLA, ARA, ETA and EPA; and the composition of each is presented as a % of the total fatty acids.

TABLE 45

Lipid Composition In *Yarrowia* Strain Y2067U Engineered To Overexpress *M. alpina* LPAAT2

| Strain | Total Fatty Acids | | | | | | | |
|---|---|---|---|---|---|---|---|---|
| | 18:0 | 18:1 | 18:2 | GLA | DGLA | ARA | ETA | EPA |
| Y2067U + pZUF-MOD-1 #1 | 1.1 | 4.7 | 10.9 | 19.4 | 6.3 | 0.9 | 3.9 | 13.8 |
| Y2067U + pZUF-MOD-1 #2 | 0.9 | 4.4 | 9.5 | 19.3 | 6.6 | 0.9 | 4.0 | 14.1 |
| Y2067U + pMLPAT-17 #1 | 1.0 | 4.4 | 9.8 | 18.6 | 5.9 | 0.8 | 3.4 | 15.5 |
| Y2067U + pMLPAT-17 #2 | 0.7 | 3.5 | 8.4 | 16.7 | 6.2 | 1.0 | 2.9 | 16.0 |
| Y2067U + pMLPAT-Int #1 | 1.9 | 4.9 | 13.9 | 21.1 | 4.8 | 1.1 | 2.7 | 16.6 |
| Y2067U + pMLPAT-Int #2 | 1.7 | 4.2 | 12.1 | 21.3 | 5.2 | 1.2 | 2.9 | 17.3 |

As demonstrated above, expression of the *M. alpina* LPAAT2 from pMLPAT-17 increased the % EPA from ~14% in the "control" strains to 15.5-16%. An additional increase in EPA to 16.6-17.3% was achieved when *M. alpina* LPMT2 was integrated into the genome with pMLPAT-Int. Further increase would be expected, if the native *Yarrowia lipolytica* LPAAT1 (SEQ ID NOs:84 and 85) and/or LPAAT2 (SEQ ID NOs:87 and 88) were knocked-out in e.g., strain Y2067U+ pMLPAT-Int.

Example 21

Mortierella Alpina DGAT1 Expression Increases Percent PUFAs

The present Example describes increased EPA biosynthesis and accumulation in *Yarrowia lipolytica* strain Y2067U (Example 4) that was transformed to co-express the *M. alpina* DGAT1 cDNA (SEQ ID NO:96). It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *M. alpina* DGAT1 was similarly co-expressed therein (e.g., strains Y2088, Y2089, Y2090, Y2095, Y2096, Y2102, Y2201 and/or Y2203).

The *M. alpina* DGAT1 ORF was cloned as follows. First, to aid the cloning of the cDNA, the sequence of the second codon of the DGAT1 was changed from 'ACA' to 'GCA', resulting in an amino acid change of threonine to alanine. This was accomplished by amplifying the complete coding region of the *M. alpina* DGAT1 ORF with primers MACAT-F1 and MACAT-R (SEQ ID NOs:307 and 308). Specifically, the PCR reaction mixture contained 1 µl each of a 20 µM solution of primers MACAT-F1 and MACAT-R, 1 µl of *M. alpina* cDNA (supra, Example 19), 22 µl water and 25 µl ExTaq premix 2×Taq PCR solution (TaKaRa Bio Inc., Otsu, Shiga, 520-2193, Japan). Amplification was carried out as follows: initial denaturation at 94° C. for 150 sec, followed by 30 cycles of denaturation at 94° C. for 30 sec, annealing at 55° C. for 30 sec, and elongation at 72° C. for 90 sec. A final elongation cycle at 72° C. for 10 min was carried out, followed by reaction termination at 4° C. A ~1600 bp DNA fragment was obtained from the PCR reaction. It was purified using Qiagen's PCR purification kit according to the manufacturer's protocol.

The *M. alpina* DGAT1 ORF was to be inserted into Nco I- and Not I-digested plasmid pZUF17 (SEQ ID NO:143; FIG. 11D), such that the ORF was cloned under the control of the FBAIN promoter and the PEX20-3' terminator region. However, since the DGAT1 ORF contained an internal NcoI site, it was necessary to perform two separate restriction enzyme digestions for cloning. First, ~2 µg of the purified PCR product was digested with BamHI and Nco I. The reaction mixture contained 20 U of each enzyme (Promega) and 6 µl of restriction buffer D in a total volume of 60 µl. The mixture was incubated for 2 hrs at 37° C. A ~320 bp fragment was separated by agarose gel electrophoresis and purified using a Qiagen Qiaex II gel purification kit. Separately, ~2 µg of the purified PCR product was digested with BamHI and Not I using identical reaction conditions to those above, except Nco I was replaced by Not I. A ~1280 bp fragment was isolated and purified as above. Finally, ~3 µg of pZUF17 was digested with Nco I and Not I and purified as described above, generating a ~7 kB fragment.

The ~7 kB Nco I/Not I pZUF17 fragment, the ~320 bp Nco I/BamHI DGAT1 fragment and the ~1280 bp BamHI/NotI DGAT1 fragment were ligated together in a three-way ligation incubated at room temperature overnight. The ligation mixture contained 100 ng of the 7 kB fragment and 200 ng each of the 320 bp and 1280 bp fragments, 2 µl ligase buffer, and 2 U T4 DNA ligase (Promega) in a total volume of 20 µl. The ligation products were used to transform *E. coli* Top10 chemical competent cells (Invitrogen) according to the manufacturer's protocol.

Individual colonies (12 total) from the transformation were used to inoculate cultures for miniprep analysis. Restriction mapping and sequencing showed that 5 out of the 12 colonies harbored the desired plasmid, which was named "pMDGAT1-17" (FIG. 18D; SEQ ID NO:156).

*Y. lipolytica* strain Y2067U (from Example 4) was transformed with pMDGAT1-17 and pZUF-MOD-1 (supra, Example 20), respectively, according to the General Methods. Transformants were grown for 2 days in synthetic MM supplemented with amino acids, followed by 4 days in HGM. The fatty acid profile of two transformants containing pMDGAT1-17 and two transformants containing pZUF-MOD-1 are shown below in Table 46, based on GC analysis (as described in the General Methods). Fatty acids are identified as 18:0, 18:1 (oleic acid), 18:2 (LA), GLA, DGLA, ARA, ETA and EPA; and the composition of each is presented as a % of the total fatty acids.

TABLE 46

Lipid Composition In *Yarrowia* Strain Y2067U Engineered To Overexpress *M. alpina* DGAT1

| Strain | Total Fatty Acids | | | | | | | |
|---|---|---|---|---|---|---|---|---|
| | 18:0 | 18:1 | 18:2 | GLA | DGLA | ARA | ETA | EPA |
| Y2067U + pZUF-MOD-1 #1 | 1.31 | 6.92 | 12.03 | 23.11 | 5.72 | 1.05 | 3.80 | 13.20 |
| Y2067U + pZUF-MOD-1 #2 | 1.39 | 6.83 | 12.15 | 21.99 | 5.83 | 1.07 | 3.82 | 13.47 |
| Y2067U + pMDGAT1-17 #1 | 0.89 | 7.13 | 10.87 | 24.88 | 5.82 | 1.19 | 3.97 | 14.09 |
| Y2067U + pMDGAT1-17 #2 | 0.86 | 7.20 | 10.25 | 22.42 | 6.35 | 1.26 | 4.38 | 15.07 |

As demonstrated above, expression of the *M. alpina* DGAT1 from plasmid pMDGAT1-17 increased the % EPA from ~13.3% in the "control" strains to ~14.1% ("Y2067U+pMDGAT1-17 #1") and ~15.1% ("Y2067U+pMDGAT1-17 #2"), respectively. An additional increase in EPA would be expected, if the native *Yarrowia lipolytica* DGAT1 (SEQ ID NOs:94 and 95) were knocked-out in e.g., strain Y2067U+pMDGAT1-17.

Example 22

*Mortierella alpina* DGAT2 Increases Percent PUFAs

The present Example describes increased EPA biosynthesis and accumulation in *Yarrowia lipolytica* strain Y2067U (Example 4) that was transformed to co-express the *M. alpina* DGAT2 cDNA (SEQ ID NO:108). It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *M. alpina* DGAT2 was similarly co-expressed therein (e.g., strains Y2088, Y2089, Y2090, Y2095, Y2096, Y2102, Y2201 and/or Y2203).

The *M. alpina* DGAT2 ORF was cloned into plasmid pZUF17 as follows. First, the ORF was PCR-amplified using primers MDGAT-F and MDGAT-R1 (SEQ ID NOs:309 and 310) from the *M. alpina* cDNA (supra, Example 19). The expected 1015 bp fragment was isolated, purified, digested with NcoI and NotI and cloned into Nco I-Not I cut pZUF17 vector (SEQ ID NO:143; FIG. 11D), such that the gene was under the control of the *Y. lipolytica* FBAIN promoter and the PEX20-3' terminator region. Correct transformants were confirmed by restriction analysis of miniprep DNA and the resultant plasmid was designated as "pMDGAT2-17" (SEQ ID NO:157).

*Y. lipolytica* strain Y2067U (from Example 4) was transformed with pMDGAT2-17 and pZUF-MOD-1 (supra, Example 20), respectively, according to the General Methods. Transformants were grown for 2 days in synthetic MM supplemented with amino acids, followed by 4 days in HGM.

The fatty acid profile of two transformants containing pMD-GAT2-17 and two transformants containing pZUF-MOD-1 are shown below based on GC analysis (as described in the General Methods). Fatty acids are identified as 18:0, 18:1 (oleic acid), 18:2 (LA), GLA, DGLA, ARA, ETA and EPA; and the composition of each is presented as a % of the total fatty acids.

TABLE 47

Lipid Composition In *Yarrowia* strain Y2067U Engineered To Overexpress *M. alpina* DGAT2

| Strain | Total Fatty Acids | | | | | | | |
|---|---|---|---|---|---|---|---|---|
| | 18:0 | 18:1 | 18:2 | GLA | DGLA | ARA | ETA | EPA |
| Y2067U + pZUF-MOD-1 #1 | 1.31 | 6.92 | 12.03 | 23.11 | 5.72 | 1.05 | 3.80 | 13.20 |
| Y2067U + pZUF-MOD-1 #2 | 1.39 | 6.83 | 12.15 | 21.99 | 5.83 | 1.07 | 3.82 | 13.47 |
| Y2067U + pMDGAT2-17 #1 | 0.00 | 7.47 | 10.77 | 25.30 | 5.70 | 1.43 | 3.45 | 15.12 |
| Y2067U + pMDGAT2-17 #2 | 1.45 | 7.79 | 9.96 | 25.16 | 6.06 | 1.25 | 3.99 | 15.37 |

Expression of the *M. alpina* DGAT2 from plasmid pMD-GAT2-17 increased the % EPA from ~13.3% in the "control" strains to ~15.25% ("Y2067U +pMDGAT2-17"). An additional increase in EPA would be expected, if the native *Yarrowia lipolytica* DGAT2 (SEQ ID NOs:102-107) were knocked-out in e.g., strain Y2067U+pMDGAT2-17.

Example 23

*Mortierella alpina* GPAT Increases Percent PUFAs

The present Example describes increased DGLA biosynthesis and accumulation (and reduced quantities of 18:1) in *Yarrowia lipolytica* strain Y2107U1 (Example 9) that was transformed to co-express the *M. alpina* GPAT ORF (SEQ ID NO:110). It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *M. alpina* GPAT was similarly co-expressed therein (e.g., strains Y2088, Y2089, Y2090, Y2095, Y2096, Y2102, Y2201 and/or Y2203).

Identification of a *M. Alpina* GPAT Using Degenerate PCR Primers

Based on sequences of GPAT from *Aspergillus nidulans* (GenBank Accession No. EAA62242) and *Neurospora crassa* (GenBank Accession No. XP_325840), the following primers were designed for degenerate PCR:

```
MGPAT-N1   CCNCAYGCNAAYCARTTYGT    (SEQ ID NO:311)

MGPAT-NR5  TTCCANGTNGCCATNTCRTC    (SEQ ID NO:312)

[Note: The nucleic acid degeneracy code used for

SEQ ID NOs:311 and 312 was as follows:

R = A/G; Y = C/T; and N = A/C/T/G.]
```

PCR amplification was carried out in a Perkin Elmer Gene-Amp 9600 PCR machine using TaKaRa ExTaq premix Taq polymerase (TaKaRa Bio Inc., Otsu, Shiga, Japan). Amplification was carried out as follows: 30 cycles of denaturation at 94° C. for 30 sec, annealing at 55° C. for 30 sec and elongation at 72° C. for 90 sec, followed by a final elongation cycle at 72° C. for 7 min.

A fragment of ~1.2 kB was obtained (SEQ ID NO:112). This fragment was purified with a Qiagen QiaQuick PCR purification kit, cloned into the TOPO® cloning vector pCR2.1-TOPO (Invitrogen), and sequenced. The resultant sequence, when translated, had homology to known GPATs, based on BLAST program analysis.

Based on the sequence of the 1212 bp cDNA fragment, the 5' and 3' end regions of the *M. alpina* GPAT were cloned by PCR amplification and genome walking techniques. This enabled assembly of a contig, corresponding to the ~1050 bp to +2885 bp region of the *M. alpina* GPAT (SEQ ID NO:113). This contig included the entire coding region of GPAT and four introns (SEQ ID NOs:117, 118, 119 and 120).

Specifically, the *M. alpina* cDNA sample described in Example 19 (1 µl) was used as a template for amplification of the 3'-end of the GPAT. MGPAT-5N1 (SEQ ID NO:313) and CDSIII/3' (SEQ ID NO:294) were used as primers. PCR amplification was carried out in a Perkin Elmer GeneAmp 9600 PCR machine using TaKaRa ExTaq premix Taq polymerase (TaKaRa Bio Inc., Otsu, Shiga, Japan). Amplification was carried out as follows: 30 cycles of denaturation at 94° C. for 30 sec, annealing at 55° C. for 30 sec and elongation at 72° C. for 120 sec, followed by a final elongation cycle at 72° C. for 7 min.

The PCR product was diluted 1:10, and 1 µl of diluted PCR product was used as template for the second round of amplification, using MGPAT-5N2 (SEQ ID NO:314) and CDSIII/3' as primers. The conditions were exactly the same as described above. The second round PCR product was again diluted 1:10 and 1 µl of the diluted PCR product used as template for a third round of PCR, using MGPAT-5N3 (SEQ ID NO:315) and CDSIII/3' as primers. The PCR conditions were again the same.

A ~1 kB fragment was generated in the third round of PCR. This fragment was purified with a Qiagen PCR purification kit and cloned into pCR2.1-TOPO vector for sequence analysis. Results from sequence analysis showed that this 965 bp fragment (SEQ ID NO:114) corresponded with the 3'-end of the GPAT gene.

A Clontech Universal GenomeWalker™ kit was used to obtain a piece of genomic DNA corresponding to the 5'-end region of the *M. alpina* GPAT. Briefly, 2.5 µg each of *M. alpina* genomic DNA was digested with DraI, EcoRV, PvuII or StuI individually, the digested DNA samples were purified using Qiagen Qiaquick PCR purification kits and eluted with 30 µl each of kit buffer EB, and the purified samples were then ligated with Genome Walker adaptor (SEQ ID NOs:316 [top strand] and 317 [bottom strand]), as shown below:

5'-GTAATACGACTCACTATAGGGCACGCGTGGTCGACGGCCCGGGCTGGT-3'

3'-H2N-CCCGACCA-5'

Each ligation reaction mixture contained 1.9 µl of 25 µM Genome Walker adaptor, 1.6 µl 10× ligation buffer, 0.5 µl T4 DNA ligase and 4 µl of one of the purified digested genomic DNA samples. The reaction mixtures were incubated at 16° C. overnight. The reaction was terminated by incubation at 70° C. for 5 min. Then, 72 µl of 10 mM Tris HCl, 1 mM EDTA, pH 7.4 buffer was added to each ligation reaction mix.

Four separate PCR reactions were performed, each using one of the four ligation mixtures as template. The PCR reaction mixtures contained 1 µl of ligation mixture, 0.5 µl of 20 µM MGPAT-5-1A (SEQ ID NO:318),1 µl of 10 µM kit primer AP1 (SEQ ID NO:319), 22.5 µl water, and 25 µl ExTaq premix Taq 2×PCR solution (TaKaRa). The PCR reactions were carried out for 32 cycles using the following conditions: denaturation at 94° C. for 30 sec, annealing at 55° C. for 30 sec, and elongation at 72° C. for 180 sec. A final elongation cycle at 72° C. for 7 min was carried out, followed by reaction termination at 4° C.

The products of each PCR reaction were diluted 1:50 individually and used as templates for a second round of PCR. Each reaction mixture contained 1 µl of one of the diluted PCR product as template, 0.5 µl of 20 µM MGPAT-3N1 (SEQ ID NO:320), 21 µl of 10 µM kit primer AP2 (SEQ ID NO:321), 22.5 µl water and 25 µl of ExTaq premix Taq 2×PCR solution (TaKaRa). PCR reactions were carried out for 32 cycles using the same thermocycler conditions described above.

A DNA fragment was obtained from the second round of PCR. This fragment was purified and cloned into pCR2.1-TOPO and sequenced. Sequence analysis showed that the 1908 bp fragment (SEQ ID NO:115) was the 5'-end of the *M. alpina* GPAT gene.

Similarly, a 966 bp fragment (SEQ ID NO:116) was obtained by two rounds of genome walking as described above, except using primer MGPAT-5N1 as the gene specific primer for the first round of PCR and primer MGPAT-5N2 as the gene specific primer for the second round. This fragment was also purified, cloned into pCR2.1-TOPO and sequenced. Sequence analysis showed that it contained a portion of the GPAT gene; however, the fragment was not long enough to extend to either end of the gene. Comparison with the 3' cDNA sequence (SEQ ID NO:114) showed that the last 171 bp of the ORF was not included.

Assembly of the Full-Length GPAT Sequence from *Mortierella Alpina*

A 3935 bp sequence (SEQ ID NO:113) containing the complete GPAT gene (comprising a region extending 1050 bases upstream of the GPAT translation initiation 'ATG' codon and extending 22 bases beyond the GPAT termination codon) was assembled from the sequences of the original partial cDNA fragment (SEQ ID NO:112), the 3' cDNA fragment (SEQ ID NO:114), the internal genomic fragment (SEQ ID NO:116), and the 5' genomic fragment (SEQ ID NO:115) described above (graphically illustrated in FIG. 19). Included in this region is the 2151 bp GPAT ORF. The complete nucleotide sequence of the *M. alpina* GPAT ORF from 'ATG' to the stop codon 'TAG' is provided as SEQ ID NO:110 (corresponding to bases 1050 to 2863 of SEQ ID NO:113, excluding the four introns (i.e., intron 1 [SEQ ID NO:117], corresponding to bases 1195 to 1469 of SEQ ID NO:113; intron 2 [SEQ ID NO:118], corresponding to bases 1585 to 1839 of SEQ ID NO:113; intron 3 [SEQ ID NO:119], corresponding to bases 2795 to 2877 of SEQ ID NO:113 and intron 4 [SEQ ID NO:120], corresponding to bases 2940 to 3038 of SEQ ID NO:113). The translated amino acid sequence (SEQ ID NO:111) showed homology with a number of fungal, plant and animal GPATs.

More specifically, identity of the sequence was determined by conducting BLAST (Basic Local Alignment Search Tool; Altschul, S. F., et al., *J. Mol. Biol.* 215:403-410 (1993)) searches. The amino acid fragment described herein as SEQ ID NO:111 had 47% identity and 65% similarity with the protein sequence of the putative GPAT of *Ustilago maydis* (GenBank Accession No. EAK84237), with an expectation value of 1e-152; additionally, SEQ ID NO:111 had 47% identity and 62% similarity with the GPAT of *Aspergillus fumigatus* (GenBank Accession No. EAL20089), with an expectation value of 1e-142.

Construction of Plasmid PMGPAT-17, Comprising a FBAIN::MGPAT::PEX20-3' Chimeric Gene The *M. alpina* GPAT ORF was cloned as follows. Primers MGPAT-cDNA-5 and MGPAT-cDNA-R (SEQ ID NOs:322 and 323) were used to amplify the GPAT ORF from the cDNA of *M. alpina* by PCR. The reaction mixture contained 1 µl of the cDNA, 1 µl each of the primers, 22 µl water and 25 µl ExTaq premix 2×Taq PCR solution (TaKaRa Bio Inc., Otsu, Shiga, 520-2193, Japan). Amplification was carried out as follows: initial denaturation at 94° C. for 150 sec, followed by 30 cycles of denaturation at 94° C. for 30 sec, annealing at 55° C. for 30 sec and elongation at 72° C. for 120 sec. A final elongation cycle at 72° C. for 10 min was carried out, followed by reaction termination at 4° C. An ~2.2 kB DNA fragment was obtained from the PCR reaction. It was purified using a Qiagen PCR purification kit according to the manufacturer's protocol.

Figure 18E:
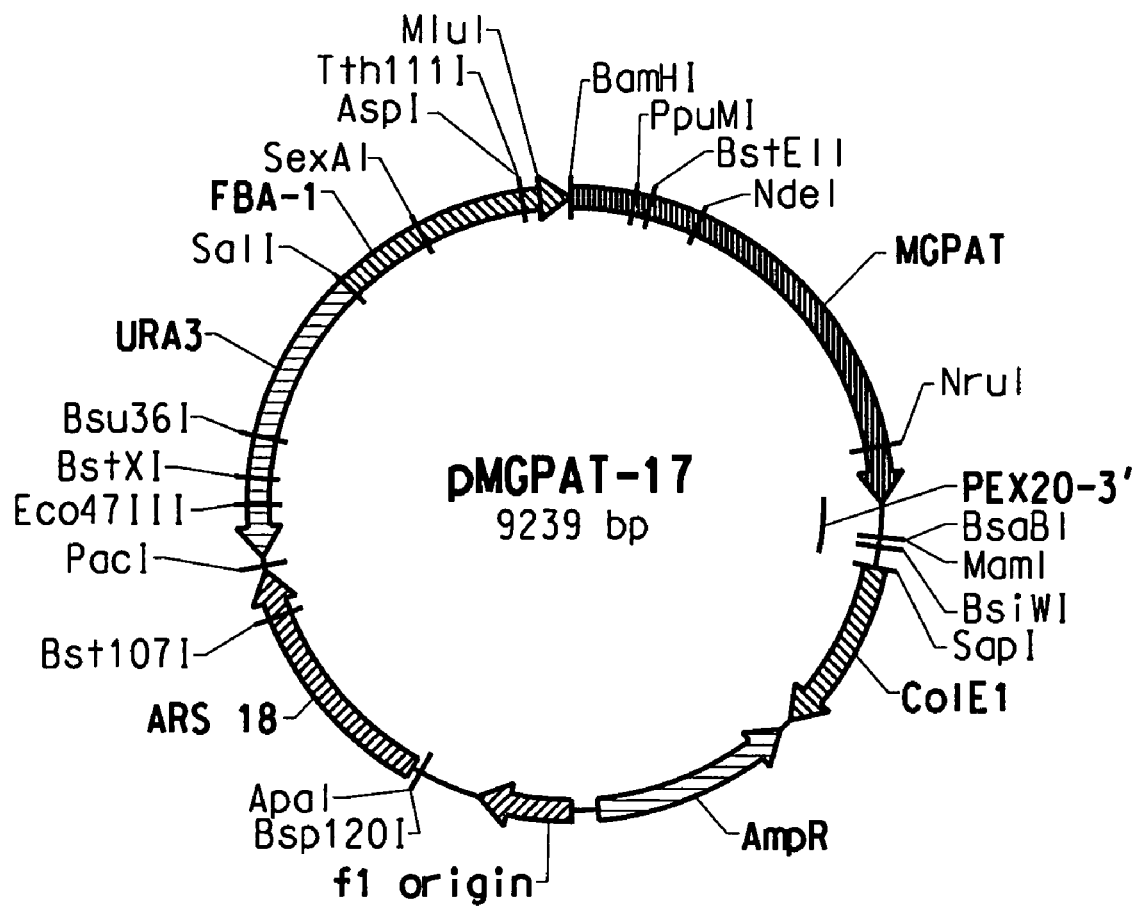

The purified PCR product was digested with BamHI and EcoRI, and a ~470 bp fragment was isolated by gel agarose electrophoresis and purified using a Qiagen gel purification kit. Separately, the PCR product was also cut with EcoRI and NotI, and a 1.69 kB fragment isolated and purified as above. The two fragments were ligated into BamHI and NotI cut pZUF-MOD-1 vector (SEQ ID NO:155; FIG. 18C), such that the gene was under the control of the *Y. lipolytica* FBAIN promoter and the PEX20-3' terminator region in the auto-replicating vector for expression in *Y. lipolytica*. Correct transformants were confirmed by restriction analysis of miniprep DNA and the resultant plasmid was designated as "pMGPAT-17" (SEQ ID NO:158; FIG. 18E).

Analysis of Lipid Composition in Transformant *Y. Lipolytica* Over-Expressing *M. Alpina* GPAT

*Y. lipolytica* strain Y2107U1 (from Example 9) was transformed with plasmid pMGPAT-17 and plasmid pZUF-MOD-1 (supra, Example 20), respectively, according to the General Methods. Transformants were grown for 2 days in synthetic MM supplemented with amino acids, followed by 4 days in HGM. The fatty acid profile of two transformants containing pZUF-MOD-1 and four transformants containing pMGPAT-17, are shown below in the Table, based on GC analysis (as described in the General Methods). Fatty acids are identified as 18:0, 18:1 (oleic acid), 18:2 (LA), GLA, DGLA, ARA, ETA and EPA; and the composition of each is presented as a % of the total fatty acids.

TABLE 48

Lipid Composition In *Yarrowia* Strain Y2107U1 Engineered To Over-Express *M. alpina* GPAT

| | Total Fatty Acids | | | | | | | |
|---|---|---|---|---|---|---|---|---|
| Strain | 18:0 | 18:1 | 18:2 | GLA | DGLA | ARA | ETA | EPA |
| Y2107U1 + pZUF-MOD-1 #1 | 2.8 | 22.7 | 9.8 | 28.5 | 2.7 | 1.7 | 0.4 | 17.4 |
| Y2107U1 + pZUF-MOD-1 #2 | 2.5 | 23.4 | 10.3 | 28.7 | 2.5 | 1.5 | 0.3 | 16.8 |
| Y2107U1 + pMGPAT-17 #1 | 3.2 | 14.8 | 11.7 | 29.8 | 5.6 | 2.0 | 0.3 | 18.4 |
| Y2107U1 + pMGPAT-17 #2 | 2.9 | 16.3 | 11.7 | 28.3 | 6.1 | 1.8 | 0.4 | 16.9 |
| Y2107U1 + pMGPAT-17 #3 | 2.1 | 14.3 | 10.8 | 27.5 | 7.2 | 1.4 | 0.4 | 17.4 |
| Y2107U1 + pMGPAT-17 #4 | 2.7 | 15.7 | 11.5 | 29.1 | 6.3 | 1.7 | 0.4 | 17.3 |

As demonstrated above, expression of the *M. alpina* GPAT from pMGPAT-17 increased the % DGLA from ~2.5% in the "control" strains to 6.5%. The level of 18:1 decreased from ~23% to ~16%. An additional increase in DGLA (or any other downstream PUFAs) would be expected, if the native *Yarrowia lipolytica* GPAT was knocked-out in a transformant strain expressing pMGPAT-17.

Example 24

*Mortierella alpina* Fatty Acid Elongase "ELO3" Increases Percent PUFAs

The present Example describes 35% more C18 fatty acids (18:0, 18:1, 18:2 and GLA) and 31% less C16 fatty acids in *Yarrowia lipolytica* strain Y2031 (Example 13) that was transformed to co-express the *M. alpina* $C_{16/18}$ fatty acid elongase ("ELO3"; SEQ ID NO:66), relative to control strains. It is contemplated that ELO3 (which could optionally be codon-optimized for increased expression), could push carbon flux into either the engineered Δ6 desaturase/Δ6 elongase pathway or the Δ9 elongase/Δ8 desaturase pathway as a means to increase production of the desired PUFA, i.e., EPA. For example, a chimeric gene comprising this $C_{16/18}$ fatty acid elongase could readily be introduced into e.g., strains Y2088, Y2089, Y2090, Y2095, Y2096, Y2102, Y2201 and/or Y2203.

Sequence Identification of a *M. alpina* $C_{16/18}$ Fatty Acid Elongase

A cDNA fragment (SEQ ID NO:68) encoding a portion of a *M. alpina* fatty acid elongase was identified from among 9,984 *M. alpina* cDNA sequences (Example 19). This fragment (SEQ ID NO:68) bore significant homology to a number of fatty acid elongases and thus was tentatively identified as an elongase.

The results of the BLAST comparison summarizing the sequence to which SEQ ID NO:68 had the most similarity are reported according to the % identity, % similarity, and Expectation value. Specifically, the translated amino acid sequence of SEQ ID NO:68 had 32% identity and 46% similarity with the protein sequence of a potential fatty acid elongase from *Candida albicans* SC5314 (GenBank Accession No. EAL04510.1, annotated therein as one of three potential fatty acid elongase genes similar to *S. cerevisiae* EUR4, FEN1 and ELO1), with an expectation value of 4e-13. Additionally, SEQ ID NO:68 had 35% identity and 53% similarity with ELO1 from *Saccharomyces cerevisiae* (GenBank Accession No. NC_001142, bases 67849-68781 of chromosome X). The *S. cerevisiae* ELO1 is described as a medium-chain acyl elongase, that catalyzes carboxy-terminal elongation of unsaturated C12-C16 fatty acyl-CoAs to C16-C18 fatty acids.

On the basis of the homologies reported above, the *Yarrowia lipolytica* gene product of SEQ ID NO:68 was designated herein as "elongase 3" or "ELO3".

Analysis of the partial fatty acid elongase cDNA sequence (SEQ ID NO:68) indicated that the 5' and 3'-ends were both incomplete. To obtain the missing 3' region of the *M. alpina* ELO3, a Clontech Universal GenomeWalker™ kit was used (as described in Example 23). Specifically, the same set of four ligation mixtures were used for a first round of PCR, using the same components and conditions as described previously, with the exception that MA Elong 3'1 (SEQ ID NO:324) and AP1 were used as primers (i.e., instead of primers MGPAT-5-1A and AP1). The second round of PCR used MA Elong 3'2 (SEQ ID NO:325) and AP2 as primers. A 1042 bp DNA fragment was obtained from the second round of PCR (SEQ ID NO:69). This fragment was purified and cloned into pCR2.1-TOPO and sequenced. Sequence analysis showed that the fragment contained the 3'-end of ELO3, including ~640 bp downstream of the 'TAA' stop codon of the gene.

The same set of four ligation mixtures used in the Clontech 3'-end RACE (supra) were also used to obtain the 5'-end region of the *M. alpina* ELO3. Specifically, a first round of PCR using the same components and conditions as described above was conducted, with the exception that MA Elong 5'1 (SEQ ID NO:326, nested at the 5' end) and AP1 were used as primers (i.e., instead of primers MA Elong 3'1 and AP1). The second round of PCR used MA Elong 5'2 (SEQ ID NO:327, nested at the 5' end) and AP2 as primers. A 2223 bp DNA fragment (SEQ ID NO:70) was obtained. It was purified and cloned into pCR2.1-TOPO and sequenced. Analysis of the sequence showed that it contained the 5'-region of the ELO3 gene.

Thus, the entire cDNA sequence of the *M. alpina* ELO3 (SEQ ID NO:71) was obtained by combining the original partial cDNA sequence (SEQ ID NO:68) with the overlapping 5' and 3' sequences obtained by genome walking (SEQ ID NOs:70 and 69, respectively; graphically illustrated in FIG. 20). This yielded a sequence of 3557 bp, identified herein as SEQ ID NO:71, comprising: 2091 bp upstream of the putative 'ATG' translation initiation codon of ELO3; the 828 bp ELO3 ORF (i.e., SEQ ID NO:66, corresponding to bases 2092-2919 of SEQ ID NO:71); and, 638 bp downstream of the ELO3 stop codon (corresponding to bases 2920-3557 of SEQ ID NO:71).

The corresponding genomic sequence of the *M. alpina* ELO3 is longer than the cDNA fragment provided as SEQ ID NO:71. Specifically, a 542 bp intron (SEQ ID NO:72) was found in the genomic DNA containing the ELO3 gene at 318 bp of the ORF; thus, the genomic DNA fragment, provided herein as SEQ ID NO:73, is 4,099 bp (FIG. 20).

The translated ELO3 protein sequence (SEQ ID NO:67) had the following homology, based on BLAST program analysis: 37% identity and 51% similarity to the potential fatty acid elongase from *Candida albicans* SC5314 (GenBank Accession No. EAL04510.1), with an expectation value of 4e-43. Additionally, the translated ELO3 shared 33% identity and 44% similarity with the protein sequence of XP_331368 (annotated therein as a "hypothetical protein") from *Neurospora crassa*, with an expectation value of 3e-44.

Construction of Plasmid PZUF6S-E3WT, Comprising a FBAIN::ELO3::PEX16-3'Chimeric Gene The *M. alpina* fatty acid ELO3 ORF was cloned as follows. Primers MA Elong 5'NcoI 3 and MA Elong 3' NotI (SEQ ID NOs:328 and 329) were used to amplify the ELO3 ORF from the cDNA of *M. alpina* (Example 19) by PCR. The reaction mixture contained 1 µl of the cDNA, 1 µl each of the primers, 22 µl water and 25 µl ExTaq premix 2×Taq PCR solution (TaKaRa). Amplification was carried out as follows: initial denaturation at 94° C. for 30 sec, followed by 32 cycles of denaturation at 94° C. for 30 sec, annealing at 55° C. for 30 sec and elongation at 72° C. for 120 sec. A final elongation cycle at 72° C. for 7 min was carried out, followed by reaction termination at 4° C. An ~830 bp DNA fragment was obtained from the PCR reaction. It was purified using a Qiagen (Valencia, Calif.) PCR purification kit according to the manufacturer's protocol. The purified PCR product was divided into two aliquots, wherein one was digested with NcoI and NspI, while the other with NspI and NotI. The ~270 bp NcoI-NspI and ~560 bp NspI-NotI fragments were cloned into NcoI-NotI cut pZF5T-PPC vector (FIG. 15B; SEQ ID NO:147) by three-piece ligation, such that the gene was under the control of the *Y. lipolytica* FBAIN promoter and the PEX16-3' terminator region (GenBank Accession No. U75433) in the auto-replicating vector for expression in *Y. lipolytica*. Correct transformants were confirmed by miniprep analysis and the resultant plasmid was designated as "pZF5T-PPC-E3" (SEQ ID NO:159).

Plasmid pZF5T-PPC-E3 was digested with ClaI and PacI and the ~2.2 kB band (i.e., the FBAIN::ELO 3::PEX16-3' fragment) was purified from an agarose gel using a Qiagen gel extraction kit. The fragment was cloned into ClaI-PacI cut pZUF6S (FIG. 21A; SEQ ID NO:160), an auto-replication plasmid containing the *Mortierella alpina* Δ6 desaturase ORF ("D6S"; GenBank Accession No. AF465281) under the control of the FBAIN promoter with a Pex20-3' terminator (i.e., a FBAIN::D6S::Pex20 chimeric gene) and a Ura3 gene. Correct transformants were confirmed by miniprep analysis and the resultant plasmid was designated as "pZUF6S-E3WT" (FIG. 21B; SEQ ID NO:161).

Analysis of Lipid Composition in Transformant *Y. lipolytica* Over-Expressing the *M. Alpina* ELO3

*Y. lipolytica* strain Y2031 (Example 13) was transformed with plasmid pZUF6S (control, comprising a FBAIN::D6S::Pex20 chimeric gene) and plasmid pZUF6S-E3WT (comprising a FBAIN::D6S::Pex20 chimeric gene and the FBAIN::ELO 3::PEX16 chimeric gene) according to the General Methods. Transformants were grown for 2 days in synthetic MM supplemented with amino acids, followed by 4 days in HGM. The fatty acid profile of six clones containing pZUF6S (clones #1-6, from a single transformation) and 22 clones (from four different transformations [i.e., #3, 5, 6, and 7]) containing pZUF6S-E3WT are shown below in Table 49, based on GC analysis (as described in the General Methods). Fatty acids are identified as 16:0 (palmitate), 16:1 (palmitoleic acid), 18:0, 18:1 (oleic acid), 18:2 (LA) and GLA; and the composition of each is presented as a % of the total fatty acids.

TABLE 49

Lipid Composition In *Yarrowia* Strain Y2031 Engineered To Over-Express *M. alpina* ELO3

| *Y. lipolytica* Strain Y2031 Transformant And/Or Clone No. | Fatty Acid Composition (% Of Total Fatty Acids) | | | | | |
|---|---|---|---|---|---|---|
| | 16:0 | 16:1 | 18:0 | 18:1 | 18:2 | GLA |
| pZUF6S #1 (control) | 9.0 | 23.2 | 1.2 | 38.2 | 19.8 | 6.9 |
| pZUF6S #2 (control) | 10.1 | 23.4 | 1.4 | 39.0 | 17.5 | 7.1 |
| pZUF6S #3 (control) | 9.7 | 22.7 | 1.4 | 39.0 | 20.2 | 7.0 |
| pZUF6S #4 (control) | 8.5 | 24.1 | 0.0 | 40.8 | 19.8 | 6.9 |
| pZUF6S #5 (control) | 9.8 | 22.4 | 1.7 | 39.1 | 20.2 | 6.8 |
| pZUF6S #6 (control) | 9.1 | 22.7 | 1.9 | 39.9 | 19.7 | 6.6 |
| pZUF6S-E3WT #3-1 | 8.9 | 17.3 | 4.1 | 36.5 | 21.6 | 11.6 |
| pZUF6S-E3WT #3-2 | 8.8 | 17.8 | 3.7 | 36.9 | 21.3 | 11.5 |
| *pZUF6S-E3WT #3-3* | *8.9* | *18.3* | *3.5* | *33.8* | *35.4* | *0.0* |
| pZUF6S-E3WT #3-6 | 8.5 | 19.9 | 4.4 | 37.8 | 17.1 | 12.3 |
| pZUF6S-E3WT #5-1 | 8.6 | 17.6 | 4.0 | 37.6 | 21.1 | 11.1 |
| pZUF6S-E3WT #5-2 | 8.8 | 17.1 | 3.9 | 37.6 | 21.3 | 11.2 |
| pZUF6S-E3WT #5-3 | 9.1 | 17.1 | 3.5 | 37.6 | 21.5 | 11.1 |
| pZUF6S-E3WT #5-4 | 8.8 | 17.9 | 4.3 | 38.0 | 19.3 | 11.7 |
| pZUF6S-E3WT #5-5 | 9.2 | 16.1 | 4.4 | 37.0 | 21.6 | 11.7 |
| *pZUF6S-E3WT #5-6* | *8.7* | *21.5* | *4.2* | *30.3* | *35.3* | *0.0* |
| pZUF6S-E3WT #6-1 | 9.4 | 16.9 | 4.6 | 36.6 | 21.5 | 11.0 |
| pZUF6S-E3WT #6-2 | 9.8 | 16.2 | 4.1 | 36.5 | 21.9 | 11.6 |
| pZUF6S-E3WT #6-3 | 9.4 | 17.0 | 4.4 | 36.2 | 21.8 | 11.3 |
| pZUF6S-E3WT #6-4 | 8.3 | 16.6 | 4.2 | 36.9 | 21.9 | 12.2 |
| pZUF6S-E3WT #6-5 | 8.8 | 18.5 | 5.5 | 36.0 | 17.8 | 13.4 |
| pZUF6S-E3WT #6-6 | 8.7 | 19.5 | 5.2 | 35.4 | 18.1 | 13.2 |
| *pZUF6S-E3WT #7-1* | *0.0* | *30.6* | *0.0* | *35.5* | *18.2* | *15.8* |
| pZUF6S-E3WT #7-2 | 8.0 | 17.7 | 4.0 | 37.7 | 20.9 | 11.7 |
| *pZUF6S-E3WT #7-3* | *0.0* | *26.7* | *4.2* | *36.0* | *21.4* | *11.7* |
| *pZUF6S-E3WT #7-4* | *0.0* | *28.1* | *4.3* | *37.0* | *16.9* | *13.6* |
| pZUF6S-E3WT #7-5 | 8.3 | 17.0 | 4.7 | 36.7 | 21.2 | 12.1 |
| pZUF6S-E3WT #7-6 | 8.0 | 18.0 | 4.8 | 36.3 | 20.8 | 12.1 |

Some of the samples (labeled in bold and italics) deviated from expected readings. Specifically, neither Y2031+pZUF6S-E3WT #3-3 nor Y2031+pZUF6S-E3WT #5-6 produced GLA. Similarly, Y2031+pZUF6S-E3WT #7-1, #7-3 and #74 had GC errors, wherein the 16:0 and 16:1 peaks were read by the GC as a single peak. As a result of these variant results, Table 50 reports the average lipid in the control and transformant strains expressing ELO3. Specifically, Table 50 shows the averages from the fatty acid profiles in Table 49, although the lines indicated by bold and italics as being incorrect in Table 49 were not included when calculating these averages. "Total C16" represents the sum of the average areas of 16:0 and 16:1, while "Total C18" reflects the sum of the average areas of 18:0, 18:1, 18:2 and GLA.

TABLE 50

Average Lipid Composition In *Yarrowia* Strain Y2031 Engineered To Over-Express *M. alpina* ELO3

| *Y. lipolytica* Strain Y2031 Transformant | Average Fatty Acid Composition (% Of Total Fatty Acids) | | | | | | Total C16 | Total C18 |
|---|---|---|---|---|---|---|---|---|
| | 16:0 | 16:1 | 18:0 | 18:1 | 18:2 | GLA | | |
| pZUF6S (control) | 9.4 | 23.1 | 1.3 | 39.3 | 19.5 | 6.9 | 32.4 | 67.1 |
| pZUF6S-E3WT #3 | 8.7 | 18.3 | 4.1 | 37.1 | 20.0 | 11.8 | 27.0 | 73.0 |
| pZUF6S-E3WT #5 | 8.9 | 17.2 | 4.0 | 37.6 | 21.0 | 11.4 | 26.1 | 73.9 |
| pZUF6S-E3WT #6 | 9.1 | 17.5 | 4.6 | 36.3 | 20.5 | 12.1 | 26.5 | 73.5 |
| pZUF6S-E3WT #7 | 8.1 | 17.6 | 4.5 | 36.9 | 21.0 | 12.0 | 25.6 | 74.4 |

Based on the data reported above, overexpression of the *M. alpina* ELO3 resulted in an increased percentage of C18 and a reduced percentage of C16 when co-expressed with a *M. alpina* Δ6 desaturase in *Yarrowia lipolytica* strain Y2031, relative to a control strain of Y2031 overexpressing the *M. alpina* Δ6 desaturase only. This indicated that the *M. alpina* ELO3 was indeed a $C_{16/18}$ fatty acid elongase.

Example 25

*Yarrowia* $C_{16/18}$ Fatty Acid Elongase "YE2" Increases Percent PUFAs

The present Example describes increased GLA biosynthesis and accumulation in *Yarrowia lipolytica* strain Y2031 (Example 13) that was transformed to co-express the *Y. lipolytica* $C_{16/18}$ fatty acid elongase ("YE2"; SEQ ID NO:74). It is contemplated that the YE2 elongase could push carbon flux into either the engineered Δ6 desaturase/Δ6 elongase pathway or the Δ9 elongase/Δ8 desaturase pathway as a means to increase production of the desired PUFA, i.e., EPA. For example, a chimeric gene comprising this $C_{16/18}$ fatty acid elongase could readily be introduced into e.g., strains Y2088, Y2089, Y2090, Y2095, Y2096, Y2102, Y2201 and/or Y2203.

Sequence Identification of a *Yarrowia lipolytica* $C_{16/18}$ Fatty Acid Elongase A novel fatty acid elongase candidate from *Y. lipolytica* was identified by sequence comparison using the rat Elo2 $C_{16/18}$ fatty acid elongase protein sequence (GenBank Accession No. AB071986; SEQ ID NO:64) as a query sequence. Specifically, this rElo2 query sequence was used to search GenBank and the public *Y. lipolytica* protein database of the "Yeast project *Genolevures*" (Center for Bioinformatics, LaBRI, Talence Cedex, France) (see also Dujon, B. et al., *Nature* 430 (6995):35-44 (2004)). This resulted in the identification of a homologous sequence, GenBank Accession No. CAG77901 (SEQ ID NOs:74 and 75), annotated as an "unnamed protein product"). This gene was designated as YE2.

Comparison of the *Yarrowia* YE2 amino acid sequences to public databases, using a BLAST algorithm (Altschul, S. F., et al., *Nucleic Acids Res.* 25:3389-3402 (1997)), revealed that the most similar known amino acid sequence was that from *Candida albicans* SC5314 (SEQ ID NO:76, GenBank Accession No. EAL04510), annotated as a probable fatty acid elongase. The proteins shared about 40% identity and scored at 236 with an E value of 7e-61.

Isolation of *Yarrowia* YE2 Gene

Figure 21A:
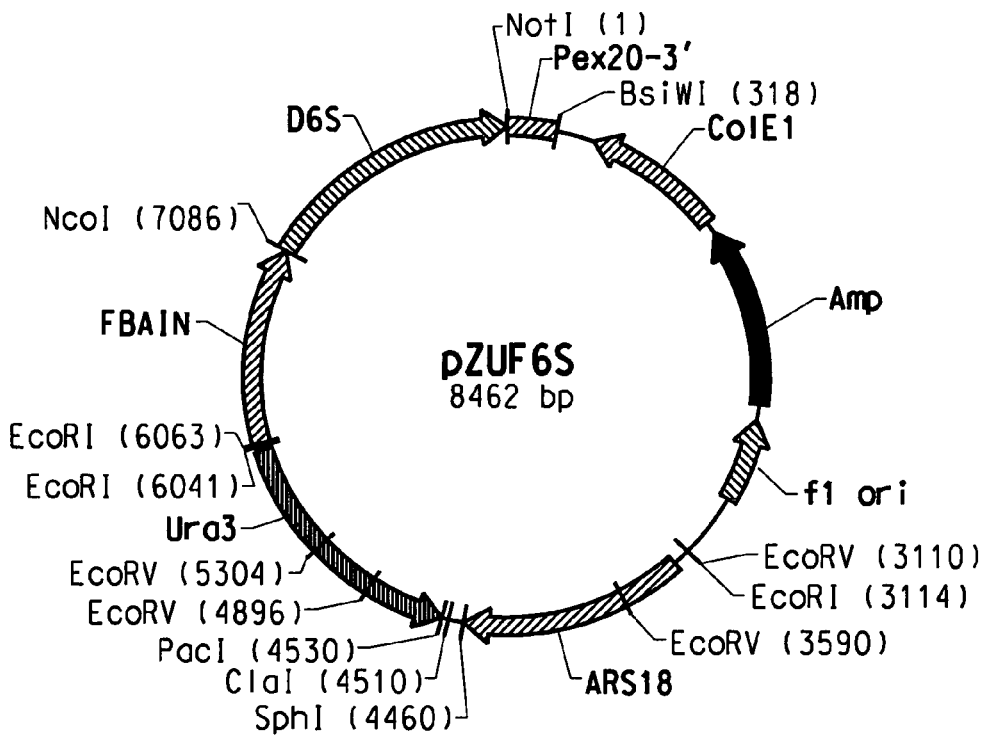
Figure 21B:
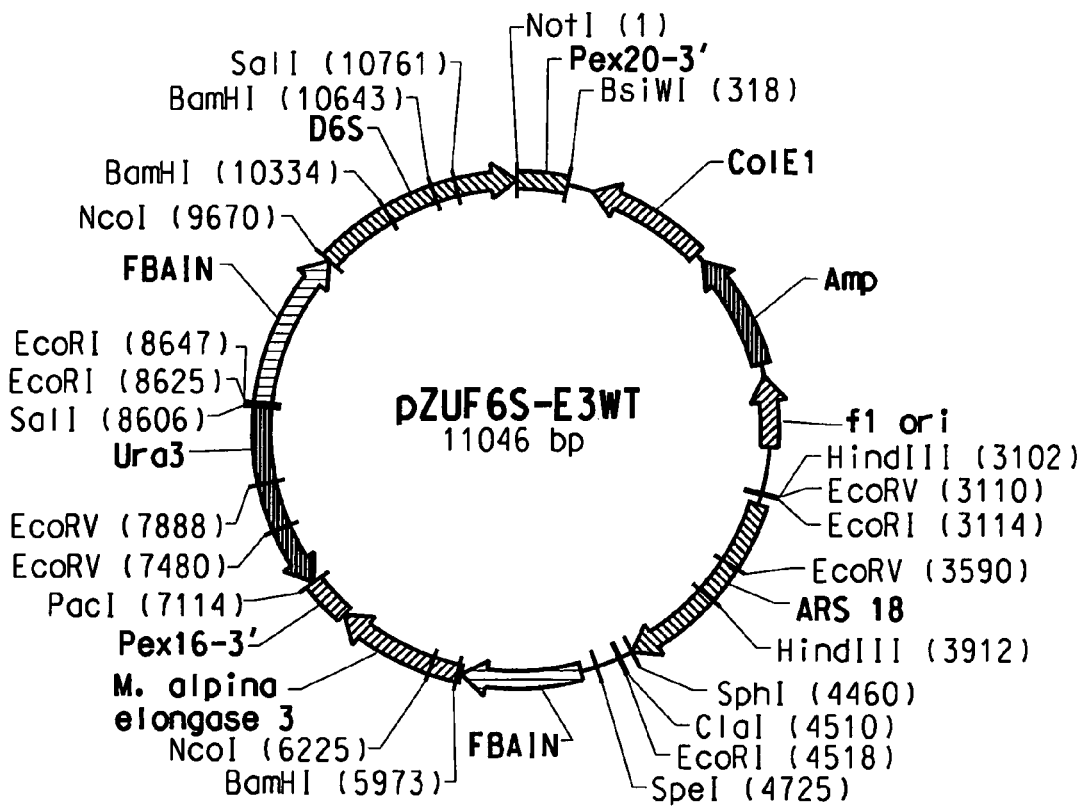
Figure 21C:
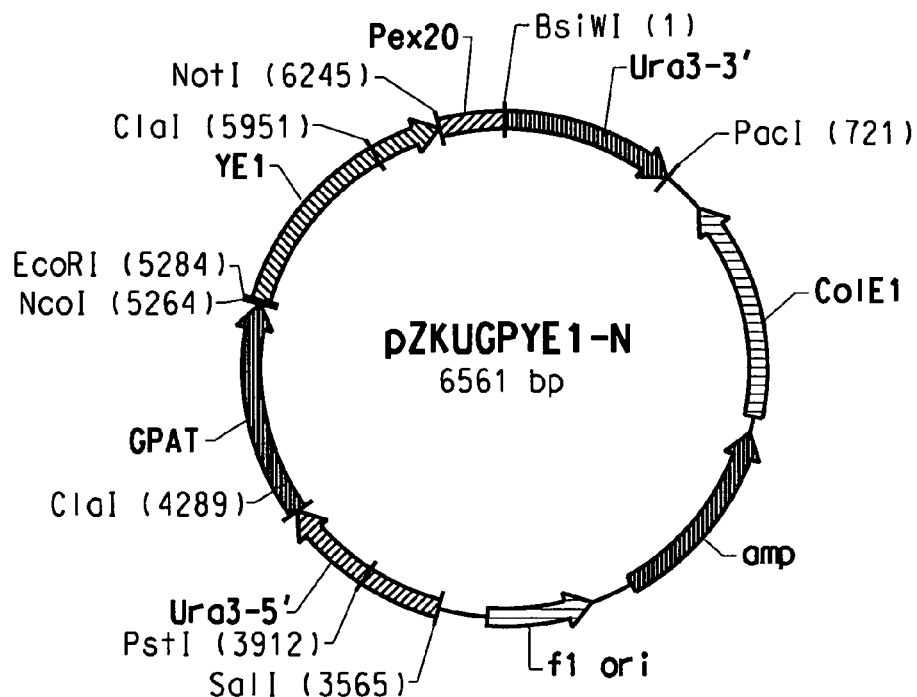
Figure 21D:
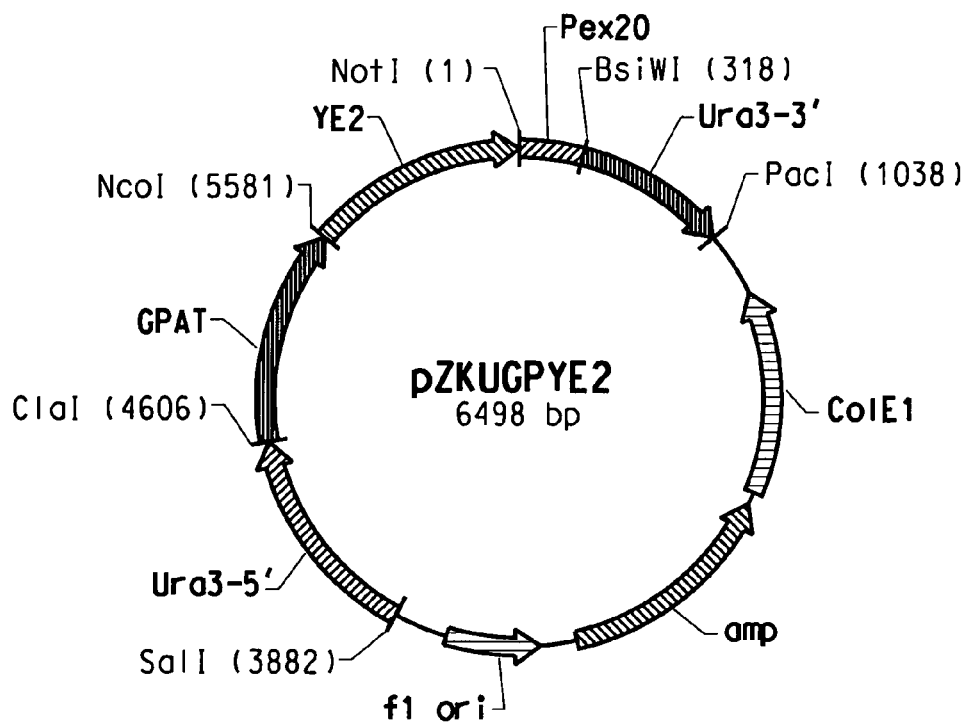

The coding region of the YE2 gene was amplified by PCR using *Yarrowia* genomic DNA as template and oligonucleotides YL597 and YL598 (SEQ ID NOs:330 and 331) as primers. The PCR reaction was carried out in a 50 μl total volume, as described in the General Methods. The thermocycler conditions were set for 35 cycles at 95° C. for 1 min, 56° C. for 30 sec, 72° C. for 1 min, followed by a final extension at 72° C. for 10 min. The PCR products of the YE2 coding region were purified, digested with NcoI/NotI, and then ligated with NcoI/NotI digested pZKUGPYE1-N (infra, Example 26; see also FIG. 21C, SEQ ID NO:162) to generate pZKUGPYE2 (FIG. 21D, SEQ ID NO:163). The addition of a NcoI site around the 'ATG' translation initiation codon changed the second amino acid of YE2 from L to V.

The ClaI/NotI fragment of pZKUGPYE2 (containing the GPAT promoter and YE2 coding region) and a NotI/PacI fragment containing the Aco terminator (prepared by PCR amplifying the ACO 3' terminator with primers YL325 and YL326 [SEQ ID NOs:402 and 403] and then digesting with NotI/PacI), were directionally ligated with ClaI/PacI digested vector pZUF6S to produce pZUF6YE2. The ClaI/NcoI fragment of pZKUT16 (containing the TEF promoter) and the NcoI/PacI fragment of pZUF6YE2 (containing the coding region of YE2 and the Aco terminator) were subsequently directionally ligated with ClaI/PacI digested vector pZUF6S to produce pZUF6TYE2 (SEQ ID NO:164).

Analysis of Lipid Composition in Transformant *Y. lipolytica* Over-Expressing YE2

Plasmid pZUF6S (FIG. 21A, SEQ ID NO:160) and pZUF6TYE2 (SEQ ID NO:164) were used to separately transform *Yarrowia* strain Y2031. The components of these two plasmids are described in Table 51 and 52.

TABLE 51

Description of Plasmid pZUF6S (SEQ ID NO: 160)

| RE Sites And Nucleotides Within SEQ ID NO: 160 | Description Of Fragment And Chimeric Gene Components |
|---|---|
| EcoRI/ClaI (3114-4510) | *Yarrowia* autonomous replicating sequence 18 (ARS18; GenBank Accession No. M91600) |
| SalI/PacI (6022-4530) | *Yarrowia* Ura3 gene (GenBank Accession No. AJ306421) |
| EcoRI/BsiWI (6063-318) | FBAIN::Δ6S::Pex20, comprising: FBAIN: FBAIN promoter (SEQ ID NO: 177) Δ6S: codon-optimized Δ6 desaturase gene (SEQ ID NO: 3), derived from *Mortierella alpina* (GenBank Accession No. AF465281) Pex20: Pex20 terminator sequence from *Yarrowia* Pex20 gene (GenBank Accession No. AF054613) |

TABLE 52

Description of Plasmid pZUF6TYE2 (SEQ ID NO: 164)

| RE Sites And Nucleotides Within SEQ ID NO: 164 | Description Of Fragment And Chimeric Gene Components |
|---|---|
| EcoRI/ClaI (7461-8857) | *Yarrowia* autonomous replicating sequence 18 (ARS18; GenBank Accession No. M91600) |
| SalI/PacI (1907-415) | *Yarrowia* Ura3 gene (GenBank Accession No. AJ306421) |
| EcoRI/BsiWI (1948-4665) | FBAIN::Δ6S::Pex20: as described for pZUF6 (supra) |
| ClaI/PacI (8857-415) | TEF::YE2::Aco, comprising: TEF: TEF promoter (GenBank Accession No. AF054508) YE2: coding region of *Yarrowia* YE2 gene (SEQ ID NO: 74; GenBank Accession No. CAG77901) Aco: Aco3 terminator sequence of *Yarrowia* Aco3 gene (GenBank Accession No. AJ001301) |

*Y. lipolytica* strain Y2031 (Example 13) was transformed with plasmid pZUF6S (control) and plasmid pZUF6TYE2 according to the General Methods. Transformants were grown for 2 days in liquid MM. The fatty acid profile of eight colonies each containing pZUF6S or pZUF6YE2 are shown below in Table 53, based on GC analysis (as described in the General Methods). Fatty acids are identified as 16:0 (palmitate), 16:1 (palmitoleic acid), 18:0, 18:1 (oleic acid), 18:2 (LA) and GLA; and the composition of each is presented as a % of the total fatty acids.

TABLE 53

Comparison Of Fatty Acid Composition In *Yarrowia* Strain
Y2031 Transformed With pZUF6S And pZUF6TYE2

| Y. lipolytica Strain Y2031 Transformants | Fatty Acid Composition (% Of Total Fatty Acids) | | | | | |
|---|---|---|---|---|---|---|
| | 16:0 | 16:1 | 18:0 | 18:1 | 18:2 | GLA |
| pZUF6S #1 (control) | 15.4 | 13.8 | 2.5 | 34.1 | 16.8 | 8.3 |
| pZUF6S #2 (control) | 15.2 | 12.8 | 3.0 | 36.5 | 16.4 | 8.3 |
| pZUF6S #3 (control) | 15.1 | 12.2 | 3.2 | 36.5 | 17.1 | 8.5 |
| pZUF6S #4 (control) | 15.2 | 12.8 | 3.1 | 36.3 | 16.6 | 8.4 |
| pZUF6S #5 (control) | 14.9 | 10.9 | 3.6 | 37.4 | 18.0 | 8.7 |
| pZUF6S #6 (control) | 14.8 | 10.1 | 4.2 | 37.6 | 18.7 | 8.6 |
| pZUF6S #7 (control) | 14.7 | 11.9 | 3.0 | 36.0 | 17.8 | 9.1 |
| pZUF6S #8 (control) | 14.9 | 12.6 | 2.9 | 35.9 | 17.3 | 8.8 |
| Average | 15.0 | 12.1 | 3.2 | 36.3 | 17.3 | 8.6 |
| pZUF6TYE2 #1 | 13.1 | 8.4 | 4.4 | 42.4 | 16.8 | 9.7 |
| pZUF6TYE2 #2 | 13.1 | 7.6 | 5.3 | 40.8 | 18.6 | 9.8 |
| pZUF6TYE2 #3 | 13.5 | 8.1 | 4.6 | 39.2 | 19.0 | 10.6 |
| pZUF6TYE2 #4 | 13.4 | 7.4 | 5.7 | 39.9 | 18.7 | 9.8 |
| pZUF6TYE2 #5 | 13.4 | 8.4 | 5.5 | 45.2 | 14.3 | 7.6 |
| pZUF6TYE2 #6 | 13.4 | 7.4 | 5.5 | 39.3 | 19.2 | 10.5 |
| pZUF6TYE2 #7 | 13.4 | 8.6 | 4.4 | 40.6 | 17.9 | 9.9 |
| pZUF6TYE2 #8 | 13.2 | 7.5 | 5.4 | 41.2 | 18.0 | 9.7 |
| Average | 13.3 | 8.0 | 5.0 | 41.1 | 17.8 | 9.7 |

GC analyses showed that there were about 27.1% C16 (C16:0 and C16:1) and 62.2% C18 (C18:0, C18:1, C18:2 and GLA) of total lipids produced in the Y2031 transformants with pZUF6S; there were about 21.3% C16 and 73.6% C18 produced in the Y2031 transformants with pZUF6TYE2. Thus, the total amount of C16 was reduced about 21.4%, and the total amount of C18 was increased about 18% in the pZUF6TYE2 transformants (as compared with the transformants with pZUF6S). These data demonstrated that YE2 functions as a $C_{16/18}$ fatty acid elongase to produce C18 fatty acids in *Yarrowia*. Additionally, there was about 12.8% more GLA produced in the pZUF6TYE2 transformants relative to the GLA produced in pZUF6S transformants. These data suggested that the YE2 elongase could push carbon flux into the engineered PUFA pathway to produce more final product (i.e., GLA).

Example 26

*Yarrowia* $C_{14/16}$ Elongase "YE1" Increases Percent PUFAs

The present Example describes increased GLA biosynthesis and accumulation in *Y. lipolytica* strain Y2031 (Example 13) that was transformed to co-express the *Y. lipolytica* $C_{14/16}$ fatty acid elongase ("YE1"; SEQ ID NO:77). It is contemplated the art that the YE1 elongase could push carbon flux into either the engineered Δ6 desaturase/Δ6 elongase pathway or the Δ9 elongase/Δ8 desaturase pathway as a means to increase production of the desired PUFA, i.e., EPA. Specifically, a chimeric gene comprising this $C_{14/16}$ fatty acid elongase could readily be introduced into e.g., strains Y2088, Y2089, Y2090, Y2095, Y2096, Y2102, Y2201 and/or Y2203.

Sequence Identification of a *Yarrowia lipolytica* $C_{14/16}$ Fatty Acid Elongase A novel fatty acid elongase candidate from *Yarrowia lipolytica* was identified by sequence comparison using the rat Elo2 $C_{16/18}$ fatty acid elongase protein sequence (GenBank Accession No. AB071986; SEQ ID NO:64) as a query sequence, in a manner similar to that used in Example 25. This resulted in the identification of a homologous sequence, GenBank Accession No. CAG83378 (SEQ ID NOs:77 and 78), annotated as an "unnamed protein product". This gene was designated as "YE1".

Comparison of the *Yarrowia* YE1 amino acid sequences to public databases, using a BLAST algorithm (Altschul, S. F., et al., *Nucleic Acids Res.* 25:3389-3402 (1997)), revealed that the most similar known sequence was FEN1 from *Neurospora crassa* (GenBank Accession No. CAD70918; SEQ ID NO:79), a probable fatty acid elongase sharing about 60% identity to YE1.

Isolation of *Yarrowia* YE1 Gene

Figure 22A:
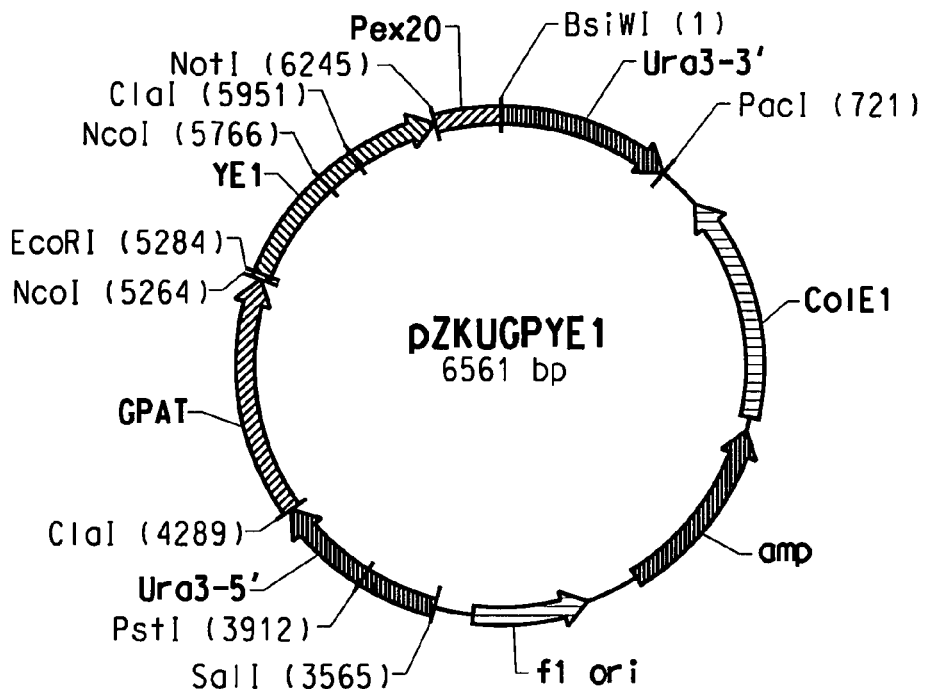
Figure 22B:
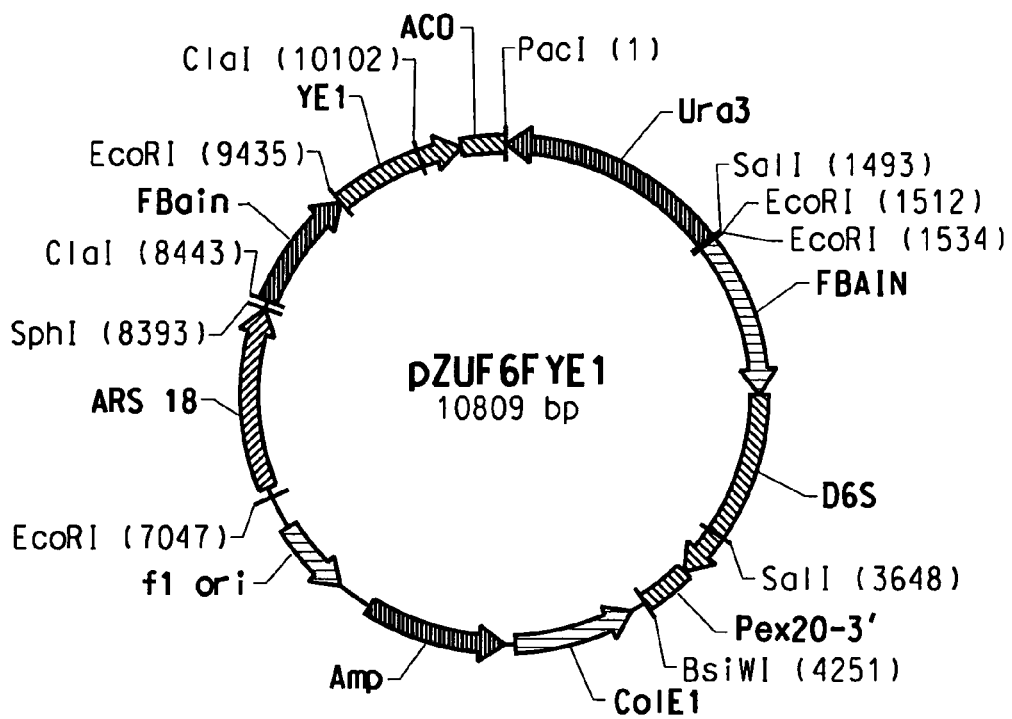

The DNA sequence of YE1 gene (SEQ ID NO:77) possesses an internal NcoI site. In order to incorporate the *Yarrowia* translation motif around the 'ATG' translation initiation codon of the YE1 gene, a two-step strategy was employed to PCR the entire YE1 gene from *Yarrowia*. Specifically, using *Yarrowia* genomic DNA as template, the first half of YE1 was amplified by PCR using oligonucleotides YL567 and YL568 (SEQ ID NOs:332 and 333) as primers, while the second half of the YE1 gene was amplified similarly using oligonucleotides YL569 and YL570 (SEQ ID NOs:334 and 335) as primers. The PCR reactions were carried out in a 50 μl total volume, as described in the General Methods. The thermocycler conditions were set for 35 cycles at 95° C. for 1 min, 56° C. for 30 sec, 72° C. for 1 min, followed by a final extension at 72° C. for 10 min. The PCR products corresponding to the 5' portion of YE1 were purified and then digested with NcoI and SacI to yield the YE1-1 fragment, while the PCR products of the 3' portion of YE1 were purified and digested with SacI and NotI to yield the YE1-2 fragment. The YE1-1 and YE1-2 fragments were directly ligated with NcoI/NotI digested pZKUGPE1 S (supra, Example 9) to generate pZKUGPYE1 (FIG. 22A, SEQ ID NO:165). The internal NcoI site of YE1 was then mutated by site-directed mutagenesis using pZKUGPYE1 as template and oligonucleotides YL571 and YL572 (SEQ ID NOs:336 and 337) as primers to generate pZKUGPYE1-N (SEQ ID NO:162). Sequence analysis showed that the mutation did not change the amino acid sequence of YE1. The addition of the NcoI site around the ATG translation initiation codon changed the second amino acid of YE1 from S to A.

The ClaI/NcoI fragment of pZF5T-PPC (containing the FBAIN promoter) and the NcoI/PacI fragment of pZKUG-PYE1-N (containing the coding region of YE1 and the Aco terminator) were directionally ligated with ClaI/PacI-digested vector pZUF6S to produce pZUF6FYE1 (SEQ ID NO:166).

Analysis of Lipid Composition in Transformant *Y. Lipolytica* Over-Expressing YE1

Plasmids pZUF6 and pZUF6FYE1 (SEQ ID NO:166) were used to separately transform *Yarrowia* strain Y2031 (from Example 13) according to the General Methods. The components of control plasmid pZUF6S (FIG. 21A; SEQ ID NO:160; comprising a FBAIN::D6S::Pex20 chimeric gene) were described in Example 25. The components of pZUF6FYE1 (FIG. 22B; SEQ ID NO:166, comprising a FBAIN::D6S::Pex20 chimeric gene and the FBAIN::YE1::Aco chimeric gene) are described in Table 54 below.

TABLE 54

Description Of Plasmid pZUF6FYE1 (SEQ ID NO: 166)

| RE Sites And Nucleotides Within SEQ ID NO: 166 | Description Of Fragment And Chimeric Gene Components |
|---|---|
| EcoRI/ClaI (7047-8445) | *Yarrowia* autonomous replicating sequence 18 (ARS18; GenBank Accession No. M91600) |
| SalI/PacI (1493-1) | *Yarrowia* Ura3 gene (GenBank Accession No. AJ306421) |
| EcoRI/BsiWI (1534-4251) | FBAIN::Δ6S::Pex20: as described for pZUF6 (supra, Example 25) |
| ClaI/PacI (8443-1) | FBAIN::YE1::Aco, comprising: FBAIN: FBAIN promoter (SEQ ID NO: 177) YE1: coding region of *Yarrowia* YE1 gene (SEQ ID NO: 77; GenBank Accession No. CAG83378) Aco: Aco3 terminator sequence from *Yarrowia* Aco3 gene (Genbank Accession No. AJ001301) |

Following transformation, transformants were grown for 2 days in synthetic MM supplemented with amino acids, followed by 4 days in HGM. The fatty acid profile of six clones containing pZUF6S and five clones containing pZUF6FYE1 are shown below in Table 55, based on GC analysis (as described in the General Methods). Fatty acids are identified as 16:0 (palmitate), 16:1 (palmitoleic acid), 18:0, 18:1 (oleic acid), 18:2 (LA) and GLA; and the composition of each is presented as a % of the total fatty acids.

TABLE 55

Comparison Of Fatty Acid Composition In *Yarrowia* Strain Y2031 Transformed With pZUF6S And pZUF6FYE1

| Transformants | Fatty Acid Composition (% Of Total Fatty Acids) | | | | |
|---|---|---|---|---|---|
|  | 16:0 | 16:1 | 18:1 | 18:2 | GLA |
| pZUF6S #1 (control) | 12.9 | 18.2 | 29.6 | 23.5 | 10.7 |
| pZUF6S #2 (control) | 12.6 | 18.6 | 29.6 | 23.8 | 10.3 |
| pZUF6S #3 (control) | 13.0 | 17.8 | 29.8 | 23.9 | 10.6 |
| pZUF6S #4 (control) | 13.1 | 18.9 | 30.1 | 22.3 | 10.3 |
| pZUF6S #5 (control) | 13.0 | 17.8 | 29.6 | 23.4 | 10.9 |
| pZUF6S #6 (control) | 12.0 | 18.7 | 30.4 | 23.2 | 10.4 |
| Average | 12.8 | 18.3 | 29.9 | 23.4 | 10.5 |
| pZUF6FYE1 #1 | 17.4 | 21.9 | 20.4 | 19.2 | 16.9 |
| pZUF6FYE1 #2 | 16.7 | 22.8 | 21.1 | 19.1 | 16.1 |
| pZUF6FYE1 #3 | 19.8 | 20.7 | 22.8 | 17.0 | 15.8 |
| pZUF6FYE1 #4 | 16.8 | 22.4 | 23.7 | 16.1 | 16.8 |
| pZUF6FYE1 #5 | 17.7 | 21.6 | 21.2 | 18.0 | 17.2 |
| Average | 17.7 | 21.9 | 21.9 | 17.9 | 16.5 |

GC analyses measured about 31.1% C16 (C16:0+C16:1) of total lipids produced in the Y2031 transformants with pZUF6S, while there was about 39.6% C16 produced in the Y2031 transformants with pZUF6FYE1. The total amount of C16 increased about 26.7% in the pZUF6FYE1 transformants, as compared to transformants with pZUF6S. Thus, these data demonstrated that YE1 functions as a $C_{14/16}$ fatty acid elongase to produce C16 fatty acids in *Yarrowia*. Additionally, there was 57% more GLA produced in the pZUF6FYE1 transformants than in pZUF6S transformants, suggesting that the YE1 elongase could push carbon flux into the engineered pathway to produce more final product (i.e., GLA).

Example 27

*Yarrowia lipolytica* CPT1 Overexpression Increases Percent PUFAs

The present Example describes increased EPA biosynthesis and accumulation in *Yarrowia lipolytica* strain Y2067U (Example 4) that was transformed to overexpress the *Y. lipolytica* CPT1 cDNA (SEQ ID NO:122). PUFAs leading to the synthesis of EPA were also increased. It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *Y. lipolytica* CPT1 was similarly co-expressed (e.g., in strains Y2088, Y2089, Y2090, Y2095, Y2096, Y2102, Y2201 and/or Y2203).

*Y. lipolytica* strain ATCC #20326 cDNA was prepared using the following procedure. Cells were grown in 200 mL YPD medium (2% Bacto-yeast extract, 3% Bactor-peptone, 2% glucose) for 1 day at 30° C. and then pelleted by centrifugation at 3750 rpm in a Beckman GH3.8 rotor for 10 min and washed twice with HGM. Washed cells were resuspended in 200 mL of HGM and allowed to grow for an additional 4 hrs at 30° C. Cells were then harvested by centrifugation at 3750 rpm for 10 min in 4×50 mL tubes.

Total RNA was isolated using the Qiagen RNeasy total RNA Midi kit. To disrupt the cells, harvested cells were resuspended in 4×600 µl of kit buffer RLT (supplemented with β-mercaptoethanol, as specified by the manufacturer) and mixed with an equal volume of 0.5 mm glass beads in four 2 mL screwcap tubes. A Biospec Mini-beadbeater was used to break the cells for 2 min at the Homogenization setting. An additional 4×600 µl buffer RLT was added. Glass beads and cell debris were removed by centrifugation, and the supernatant was used to isolate total RNA according to manufacturer's protocol.

PolyA(+)RNA was isolated from the above total RNA sample using a Qiagen Oligotex mRNA purification kit according to the manufacturer's protocol. Isolated polyA(+) RNA was purified one additional round with the same kit to ensure the purity of mRNA sample. The final purified poly (A)+RNA had a concentration of 30.4 ng/µl.

cDNA was generated, using the LD-PCR method specified by BD-Clontech and 0.1 µg of polyA(+) RNA sample, as described in Example 19, with the exception that the PCR thermocycler conditions used for $1^{st}$ strand cDNA synthesis were set for 95° C. for 20 sec, followed by 20 cycles of 95° C. for 5 sec and 68° C. for 6 min. The PCR product was quantitated by agarose gel electrophoresis and ethidium bromide staining.

The *Y. lipolytica* CPT1 cDNA was cloned as follows. Primers CPT1-5'-NcoI and CPT1-3'-NotI (SEQ ID NOs:338 and 339) were used to amplify the *Y. lipolytica* ORF from the cDNA of *Y. lipolytica* by PCR. The reaction mixture contained 0.5 µl of the cDNA, 0.5 µl each of the primers, 11 µl water and 12.5 µl ExTaq premix 2×Taq PCR solution (TaKaRa Bio Inc., Otsu, Shiga, 520-2193, Japan). Amplification was carried out as follows: initial denaturation at 94° C. for 300 sec, followed by 30 cycles of denaturation at 94° C. for 30 sec, annealing at 55° C. for 30 sec, and elongation at 72° C. for 60 sec. A final elongation cycle at 72° C. for 10 min was carried out, followed by reaction termination at 4° C. A ~1190 bp DNA fragment was obtained from the PCR reaction. It was purified using Qiagen's PCR purification kit according to the manufacturer's protocol. The purified PCR product was digested with NcoI and NotI, and cloned into Nco I-Not I cut pZUF17 vector (SEQ ID NO:143; FIG. 11D), such that the gene was under the control of the *Y. lipolytica* FBAIN promoter and the PEX20-3' terminator region. Correct transformants were confirmed by miniprep analysis and the resultant plasmid was designated as "pYCPT1-17" (SEQ ID NO:167).

Figure 22C:
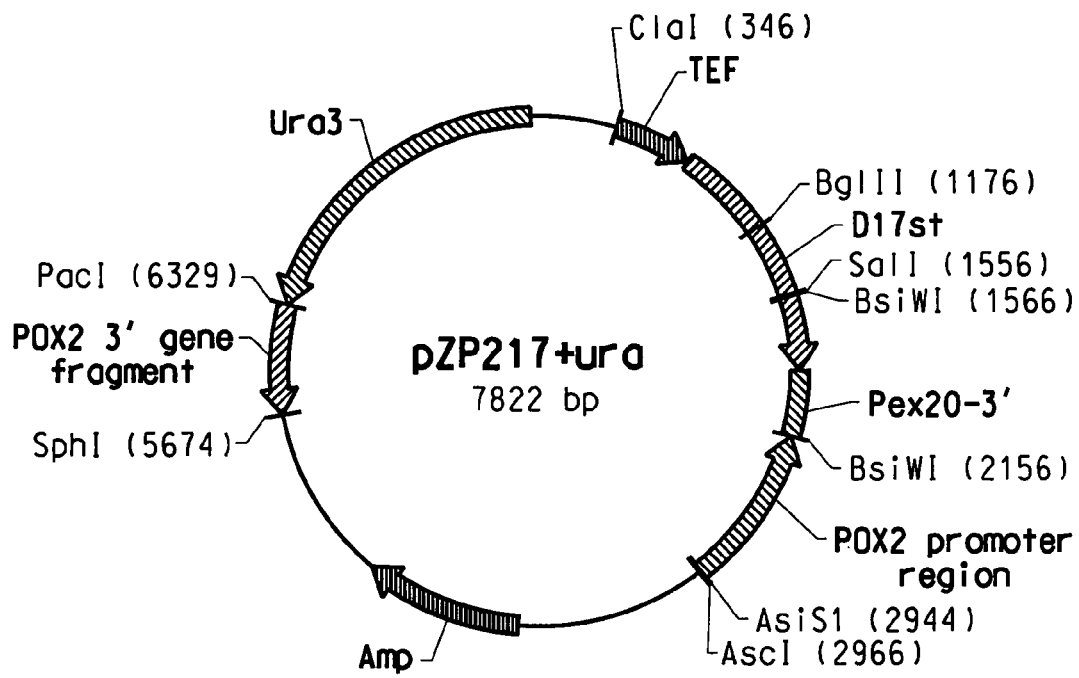

To integrate the chimeric FBAIN::CPT1::PEX20 gene into the genome of *Yarrowia lipolytica*, plasmid pYCPT1-ZP217 was created by digesting pYCPT1-17 with NcoI and NotI, and isolating the ~1190 bp fragment that contained the CPT1 ORF. This fragment was then cloned into pZP217+Ura (SEQ ID NO:168) digested with NcoI and NotI. As shown in FIG. 22C, plasmid pZP217+Ura is a *Y. lipolytica* integration plasmid comprising a chimeric TEF::synthetic Δ17 desaturase (codon-optimized for *Y. lipolytica*)::Pex20-3' gene and a Ura3 gene, for use as a selectable marker. Correct transformants were confirmed by miniprep analysis and the resultant plasmid was designated as "pYCPT1-ZP217" (SEQ ID NO:169).

*Y. lipolytica* strain Y2067U (from Example 4) was transformed with BssHII/BbuI digested pYCPT1-ZP217 and pZUF-MOD-1 (supra, Example 20), respectively, according to the General Methods. Transformants were grown for 2 days in synthetic MM supplemented with amino acids, followed by 4 days in HGM. The fatty acid profile of two transformants containing pZUF-MOD-1 and four transformants having pYCPT1-ZP217 integrated into the genome are shown below in the Table, based on GC analysis (as described in the General Methods). Fatty acids are identified as 18:0, 18:1 (oleic acid), 18:2 (LA), GLA, DGLA, ARA, ETA and EPA; and the composition of each is presented as a % of the total fatty acids.

TABLE 56

Lipid Composition In *Yarrowia* Strain Y2067U Engineered To Overexpress *Y. lipolytica* CPT1

| Strain | Total Fatty Acids | | | | | | | |
|---|---|---|---|---|---|---|---|---|
| | 18:0 | 18:1 | 18:2 | GLA | DGLA | ARA | ETA | EPA |
| Y2067U + pZUF-MOD-1 #1 | 1.3 | 6.9 | 12.0 | 23.1 | 5.7 | 1.1 | 3.8 | 13.2 |
| Y2067U + pZUF-MOD-1 #2 | 1.4 | 6.8 | 12.1 | 22.0 | 5.8 | 1.1 | 3.8 | 13.5 |
| Y2067U + pYCPT1-ZP2I7 #1 | 0.6 | 8.0 | 8.2 | 27.4 | 7.1 | 1.6 | 4.1 | 15.7 |
| Y2067U + pYCPT1-ZP2I7 #2 | 0.6 | 8.1 | 8.2 | 27.2 | 7.0 | 1.6 | 4.0 | 15.7 |
| Y2067U + pYCPT1-ZP2I7 #3 | 1.0 | 7.9 | 8.0 | 24.7 | 6.1 | 1.6 | 3.2 | 15.5 |
| Y2067U + pYCPT1-ZP2I7 #4 | 0.6 | 7.1 | 8.6 | 25.5 | 6.9 | 1.8 | 4.0 | 16.0 |

As shown above, expression of the *Y. lipolytica* CPT1 under the control of the strong FBAIN promoter, by genome integration, increased the % EPA from 13.4% in the "control" strains to 15.7-16%. Furthermore, GLA, DGLA and ARA levels also were increased.

Example 28

*Sacchromyces cerevisiae* ISC1 Increases Percent PUFAs

The present Example describes increased EPA biosynthesis and accumulation in *Yarrowia lipolytica* strain M4 (Example 4) that was transformed to co-express the *S. cerevisiae* ISC1 gene (SEQ ID NO:124). It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if the *S. cerevisiae* ISC1 was similarly co-expressed (e.g., in strains Y2088, Y2089, Y2090, Y2095, Y2096, Y2102, Y2201 and/or Y2203).

The *S. cerevisiae* ISC1 ORF was cloned into plasmid pZP217+Ura as follows. First, the ORF was PCR-amplified using genomic DNA from *S. cerevisiae* strain S288C (Promega, Madison, Wis.) and primer pair Isc1F and Isc1R (SEQ ID NOs:340 and 341). Primer Isc1F modified the wild-type 5' sequence of ISC1 from 'ATGTACAA' to 'ATG GACAA' in the amplified ORF, as it was necessary to incorporate a NcoI site and thereby keep ISC1 in frame. Amplification was carried out as follows: initial denaturation at 94° C. for 120 sec, followed by 35 cycles of denaturation at 94° C. for 30 sec, annealing at 50° C. for 30 sec and elongation at 68° C. for 120 sec. A final elongation cycle at 68° C. for 10 min was carried out, followed by reaction termination at 4° C. A 1455 bp DNA fragment was obtained from the PCR reaction for ISC1 and the PCR product size was confirmed by electrophoresis, using a 1% agarose gel (120 V for 30 min) and a 1 kB DNA standard ladder from Invitrogen (Carlsbad, Calif.).

The DNA was purified using a DNA Clean & Concentrator-5 kit from Zymo Research Corporation (Orange, Calif.), per the manufacturer's instructions, and then digested with NcoI/NotI. The ISC1 fragment was then individually cloned into pZP217+Ura (SEQ ID NO:168; FIG. 22C) digested with NcoI and NotI. Correct transformants were confirmed by gel electrophoresis and the resultant plasmid was designated as "pTEF::ISC1" (SEQ ID NO:170). Thus, this plasmid contained a DNA cassette comprising the following: 3'-POX2, URA3, TEF::ISC1::Pex20 and a POX2 promoter region.

"Control" vector was prepared as follows. First, the *S. cerevisiae* pcl1 ORF (encoding a protein involved in entry into the mitotic cell cycle and regulation of morphogenesis) was PCR amplified using genomic DNA from *S. cerevisiae* strain S288C and primer pair Pcl1F and Pcl1R (SEQ ID NOs:342 and 343). Amplification was carried out as described above. A 861 bp DNA fragment was obtained from the PCR reaction for pcl1 (confirmed by electrophoresis, supra). The DNA was purified using a DNA Clean & Concentrator-5 kit and then digested with NcoI/NotI. The fragment was then cloned into similarly digested pZP217+Ura. Correct transformants were confirmed by gel electrophoresis and the resultant plasmid was designated as "pTEF::pcl1". Plasmid pTEF::plc1 was then digested with HincII to remove the pcl1 ORF. The remaining plasmid was religated, such that a linear DNA cassette comprising 3'-POX2, URA3, TEF:: Pex20 and a POX2 promoter region resulted upon digestion with AscI/SphI.

Competent *Y. lipolytica* strain M4 cells (from Example 4) were transformed with Asc1/Sph1-digested pTEF::ISC1 and "control", respectively (wherein 5 µg of each plasmid had been subject to digestion). Transformation was accomplished using the Frozen EZ Yeast Transformation II kit (Zymo Research) and transformants were selected on plates comprising YNB without Amino Acids (6.7 g/L; Becton, Dickinson and Co., Sparks, Md. [Catalog #291940]), glucose (20 g/L) and agar (20 g/L). Several hundred transformant colonies were obtained. Integration of each DNA cassette into the *Yarrowia lipolytica* POX2 locus was confirmed by PCR using the genomic DNA from 5 independent transformants for ISC1.

Transformants were grown in YNB without amino acids containing 2% glucose for 2 days. The cells were harvested by centrifugation and resuspended in media comprising 100 g/L dextrose, 2 g/L $MgSO_4$ and 50 mM phosphate buffer at pH 6.5 for 5 additional days of growth. The cells from 0.75 mL of each culture were harvested by centrifugation and analyzed for their fatty acid composition. The fatty acid profile of 3 transformants comprising the "control" vector and 5 transformants comprising pTEF::ISC1 are shown below based on GC analysis (as described in the General Methods). Fatty acids are identified as 16:0, 16:1, 18:0, 18:1 (oleic acid), 18:2 (LA), GLA, DGLA, ARA, ETA and EPA; and the composition of each is presented as a % of the total fatty acids.

TABLE 57

Lipid Composition In *Yarrowia* Strain M4 Engineered To Overexpress *S. cerevisiae* ISC1

| | Total Fatty Acids | | | | | | | | | |
|---|---|---|---|---|---|---|---|---|---|---|
| Strain | 16:0 | 16:1 | 18:0 | 18:1 | 18:2 | GLA | DGLA | ARA | ETA | EPA |
| M4 + "control" | 14.7 | 7.2 | 2.1 | 13.5 | 8.7 | 21.8 | 8.9 | 0.9 | 4.1 | 9.3 |
| M4 + pTEF::ISC1 | 13.5 | 8.5 | 1.7 | 15.6 | 8.1 | 21.3 | 7.5 | 0.7 | 3.9 | 10.7 |

Expression of the *S. cerevisiae* ISC1 gene improved the percent EPA from 9.3% in the "control" strain to 10.7% ("M4+pTEF::ISC1"), representing a 14.5% increase.

Example 29

Generation of *Yarrowia lipolytica* Acyltransferase Knockouts

The present Example describes the creation of single, double and triple knockout strains of *Yarrowia lipolytica* that were disrupted in either PDAT, DGAT2, DGAT1, PDAT and DGAT2, PDAT and DGAT1, DGAT1 and DGAT2, or PDAT, DGAT1 and DGAT2 genes. Disruption of the gene(s) in each of the knock-out strains was confirmed and analysis of each of the disruptions on fatty acid content and composition was determined by GC analysis of total lipids in Example 30.

Targeted Disruption of the *Yarrowia Lipolytica* DGAT2 Gene

Figure 22D:
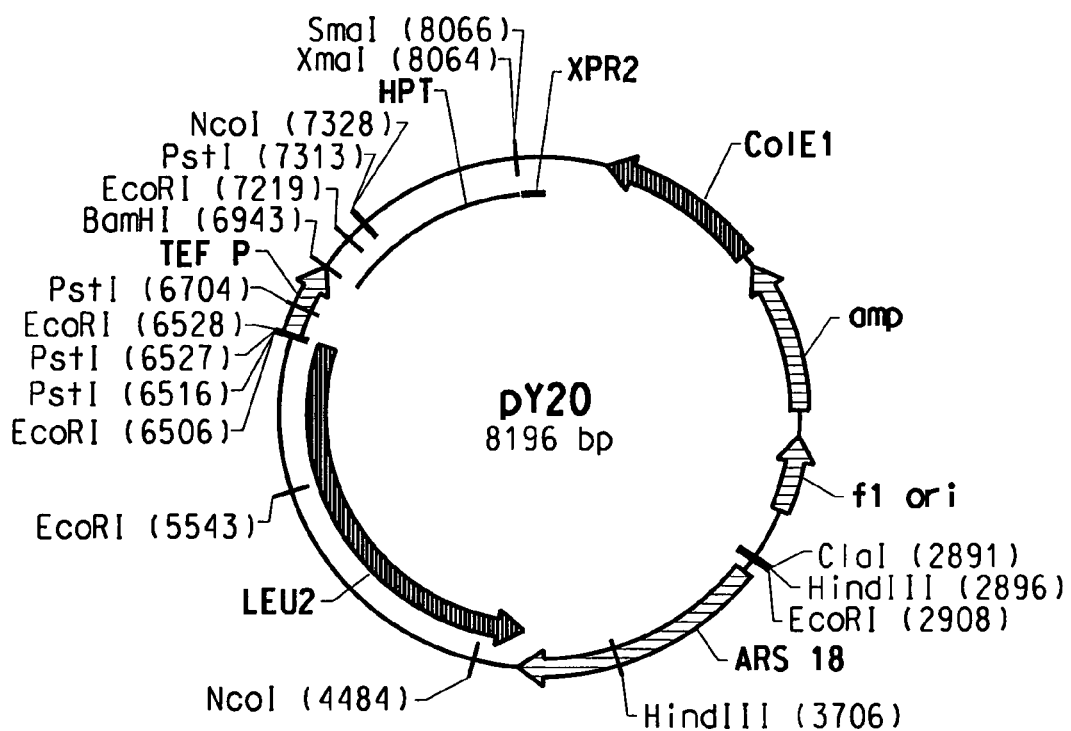

Targeted disruption of the DGAT2 gene in *Y. lipolytica* ATCC #90812 was carried out by homologous recombination-mediated replacement of the endogenous DGAT2 gene with a targeting cassette designated as plasmid pY21 DGAT2. pY21 DGAT2 was derived from plasmid pY20 (FIG. 22D; SEQ ID NO:171). Specifically, pY21DGAT2 was created by inserting a 570 bp Hind III/Eco RI fragment into similarly linearized pY20. The 570 bp DNA fragment contained (in 5' to 3' orientation): 3' homologous sequence from position +1090 to +1464 (of the coding sequence (ORF) in SEQ ID NO:102), a Bgl II restriction site and 5' homologous sequence from position +906 to +1089 (of the coding sequence (ORF) shown in SEQ ID NO:102). The fragment was prepared by PCR amplification using two pairs of PCR primers, P95 and P96 (SEQ ID NOs:344 and 345), and P97 and P98 (SEQ ID NOs:346 and 347), respectively.

pY21 DGAT2 was linearized by Bgl II restriction digestion and transformed into mid-log phase *Y. lipolytica* ATCC #90812 cells, according to the General Methods. The cells were plated onto YPD hygromycin selection plates and maintained at 30° C. for 2 to 3 days.

Fourteen *Y. lipolytica* ATCC #90812 hygromycin-resistant colonies were isolated and screened for targeted disruption by PCR. One set of PCR primers (P115 and P116 [SEQ ID NOs:348 and 349]) was designed to amplify a specific junction fragment following homologous recombination. Another pair of PCR primers (P115 and P112 [SEQ ID NO:350]) was designed to detect the native gene.

Two of the 14 hygromycin-resistant colonies of ATCC #90812 strains were positive for the junction fragment and negative for the native fragment. Thus, targeted integration was confirmed in these 2 strains, one of which was designated as "S-D2".

Targeted Disruption of the *Yarrowia lipolytica* PDAT Gene

Figure 22E:
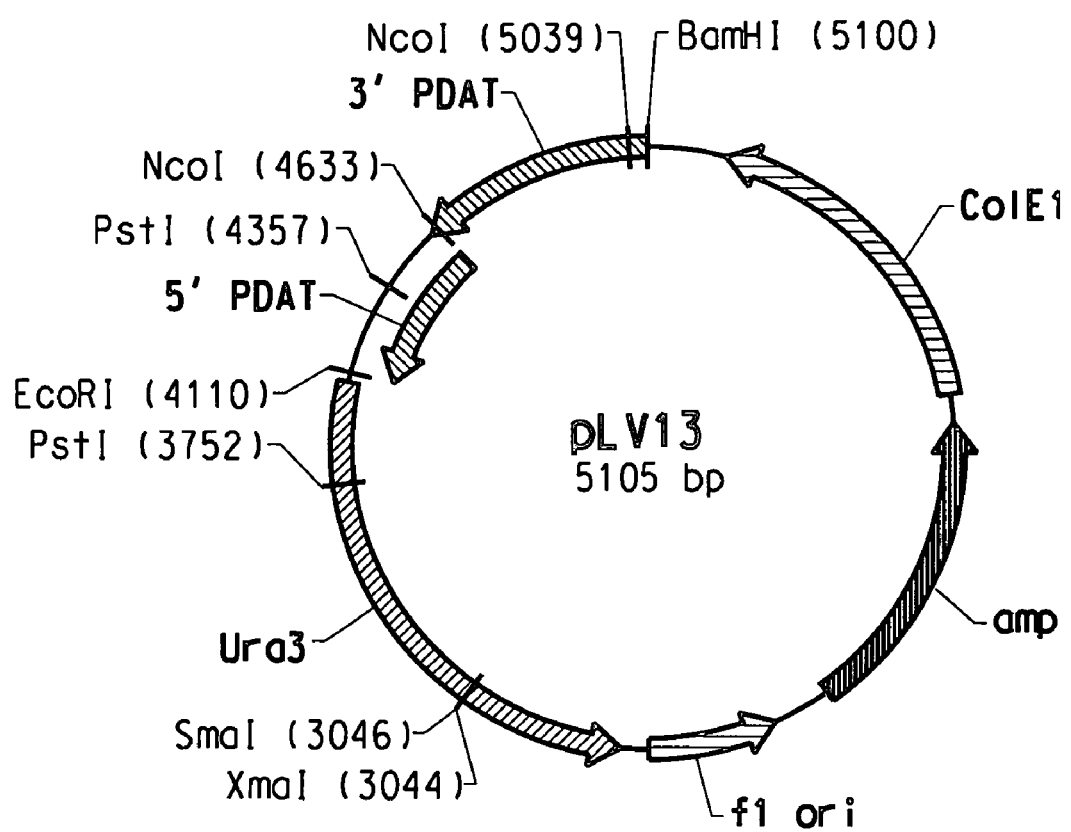

Targeted disruption of the PDAT gene in *Y. lipolytica* ATCC #90812 was carried out by homologous recombination-mediated replacement of the endogenous PDAT gene with a targeting cassette designated as pLV13 (FIG. 22E; SEQ ID NO:172). pLV13 was derived from plasmid pY20 (FIG. 22D; SEQ ID NO:171). Specifically, the hygromycin resistant gene of pY20 was replaced with the *Yarrowia* Ura3 gene to create plasmid pLV5. Then, pLV13 was created by inserting a 992 bp Bam HI/Eco RI fragment into similarly linearized pLV5. The 992 bp DNA fragment contained (in 5' to 3' orientation): 3' homologous sequence from position +877 to +1371 (of the coding sequence (ORF) in SEQ ID NO:89), a Bgl II restriction site and 5' homologous sequence from position +390 to +876 (of the coding sequence (ORF) in SEQ ID NO:89). The fragment was prepared by PCR amplification using PCR primers P39 and P41 (SEQ ID NOs:351 and 352) and P40 and P42 (SEQ ID NOs:353 and 354), respectively.

pLV13 was linearized by Bgl II restriction digestion and was transformed into mid-log phase *Y. lipolytica* ATCC #90812 cells, according to the General Methods. The cells were plated onto Bio101 DOB/CSM-Ura selection plates and maintained at 30° C. for 2 to 3 days.

Ten *Y. lipolytica* ATCC #90812 colonies were isolated and screened for targeted disruption by PCR. One set of PCR primers (P51 and P52 [SEQ ID NOs:355 and 356]) was designed to amplify the targeting cassette. Another set of PCR primers (P37 and P38 [SEQ ID NOs:357 and 358]) was designed to detect the native gene. Ten of the ten strains were positive for the junction fragment and 3 of the 10 strains were negative for the native fragment, thus confirming successful targeted integration in these 3 strains. One of these strains was designated as "S-P".

Targeted Disruption of the *Yarrowia lipolytica* DGAT1 Gene

The full-length YI DGAT1 ORF was cloned by PCR using degenerate PCR primers P201 and P203 (SEQ ID NOs:359 and 360, respectively) and *Y. lipolytica* ATCC #76982 genomic DNA as template. The degenerate primers were required, since the nucleotide sequence encoding YI DGAT1 was not known.

The PCR was carried out in a RoboCycler Gradient 40 PCR machine, with amplification carried out as follows: initial denaturation at 95° C. for 1 min, followed by 30 cycles of denaturation at 95° C. for 30 sec, annealing at 55° C. for 1 min, and elongation at 72° C. for 1 min. A final elongation cycle at 72° C. for 10 min was carried out, followed by reaction termination at 4° C. The expected PCR product (ca. 1.6 kB) was detected by agarose gel electrophoresis, isolated, purified, cloned into the TOPO® cloning vector (Invitrogen), and partially sequenced to confirm its identity.

Targeted disruption of the putative DGAT1 gene in *Y. lipolytica* ATCC #90812 was carried out by homologous recombination-mediated replacement of the endogenous DGAT1 gene with a targeting cassette (using the methodology described above for DGAT2). Specifically, the 1.6 kB isolated YI DGAT1 ORF (SEQ ID NO:94) was used as a PCR template molecule to construct a YI DGAT1 targeting cassette consisting of: 5' homologous YI DGAT1 sequence (amplified with primers P214 and P215 (SEQ ID NOs:361 and 362)), the *Yarrowia* Leucine 2 (Leu2; GenBank Accession No. AAA35244) gene, and 3' homologous YI DGAT1 sequence (amplified with primers P216 and P217 (SEQ ID NOs:363 and 364)). Following amplification of each individual portion of the targeting cassette with Pfu Ultra polymerase (Stratagene, Catalog #600630) and the thermocycler conditions described above, each fragment was purified. The three correct-sized, purified fragments were mixed together as template molecules for a second PCR reaction using PCR primers P214 and P219 (SEQ ID NO:365) to obtain the YI DGAT1 disruption cassette.

The targeting cassette was gel purified and used to transform mid-log phase wildtype *Y. lipolytica* (ATCC #90812). Transformation was performed as described in the General Methods. Transformants were plated onto Bio101 DOB/CSM-Leu selection plates and maintained at 30° C. for 2 to 3 days. Several leucine prototrophs were screened by PCR to confirm the targeted DGAT1 disruption. Specifically, one set of PCR primers (P226 and P227 [SEQ ID NOs:366 and 367]) was designed to amplify a junction between the disruption cassette and native target gene. Another set of PCR primers (P214 and P217 [SEQ ID NOs:361 and 364]) was designed to detect the native gene.

All of the leucine prototroph colonies were positive for the junction fragment and negative for the native fragment. Thus, targeted integration was confirmed in these strains, one of which was designated as "S-D1".

Creation of *Yarrowia Lipolytica* Double and Triple Knockout Strains Containing Disruptions in PDAT and/or DGAT2 and/or DGAT1 Genes The *Y. lipolytica* ATCC #90812 hygromycin-resistant "S-D2" mutant (containing the DGAT2 disruption) was transformed with plasmid pLV13 (containing the PDAT disruption) and transformants were screened by PCR, as described for the single PDAT disruption. Two of twelve transformants were confirmed to be disrupted in both the DGAT2 and PDAT genes. One of these strains was designated as "S-D2-P".

Similarly, strains with double knockouts in DGAT1 and PDAT ("S-D1-P"), in DGAT2 and DGAT1 ("S-D2-D1"), and triple knockouts in DGAT2, DGAT1 and PDAT ("S-D2-D1-P") were made.

Example 30

*Yarrowia lipolytica* Acyltransferase Knockouts Decrease Lipid Content and Increase Percent PUFAs The present Example analyzes the affect of single and/or double and/or triple acyltransferase knockouts in wildtype *Yarrowia lipolytica* and strains of *Y. lipolytica* that had been previously engineered to produce EPA, as measured by changes in fatty acid content and composition. It is contemplated that a *Y. lipolytica* host strain engineered to produce EPA via either the Δ6 desaturase/Δ6 elongase pathway or the Δ9 elongase/Δ8 desaturase pathway could demonstrate increased EPA biosynthesis and accumulation, if similar manipulations to the host's native acyltransferases were created (e.g., within strains Y2088, Y2089, Y2090, Y2095, Y2096, Y2102, Y2201 and/or Y2203).

TAG Content is Decreased in *Y. Lipolytica* ATCC #90812 with Acyltransferase Disruptions First, TAG content was compared in wildtype and mutant *Y. lipolytica* ATCC #90812 containing: (1) single disruptions in PDAT, DGAT2 and DGAT1; (2) double disruptions in PDAT and DGAT2, DGAT1 and PDAT, and DGAT1 and DGAT2; and (3) triple disruptions in PDAT, DGAT2 and DGAT1.

Specifically, one loopful of cells from plates containing wildtype and mutant *Y. lipolytica* ATCC #90812 (i.e., strains. S-D1, S-D2, S-P, S-D1-D2, S-D1-P, S-D2-P, and S-D1-D2-P) were each individually inoculated into 3 mL YPD medium and grown overnight on a shaker (300 rpm) at 30° C. The cells were harvested and washed once in 0.9% NaCl and resuspended in 50 mL of HGM. Cells were then grown on a shaker for 48 hrs. Cells were washed in water and the cell pellet was lyophilized. Twenty (20) mg of dry cell weight was used for total fatty acid by GC analysis and the oil fraction following TLC (infra) and GC analysis.

The methodology used for TLC is described below in the following five steps: (1) The internal standard of 15:0 fatty acid (10 μl of 10 mg/mL) was added to 2 to 3 mg dry cell mass, followed by extraction of the total lipid using a methanol/chloroform method. (2) Extracted lipid (50 μl) was blotted across a light pencil line drawn approximately 1 inch from the bottom of a 5×20 cm silica gel 60 plate, using 25-50 μl micropipettes. (3) The TLC plate was then dried under $N_2$ and was inserted into a tank containing about ~100 mL 80:20:1 hexane:ethyl ether:acetic acid solvent. (4) After separation of bands, a vapor of iodine was blown over one side of the plate to identify the bands. This permitted samples on the other side of the plate to be scraped using a razor blade for further analysis. (5) Basic transesterification of the scraped samples and GC analysis was performed, as described in the General Methods.

GC results are shown below in Table 58. Cultures are described as the "S" strain (wildtype), "S-P" (PDAT knockout), "S-D1" (DGAT1 knockout), "S-D2" (DGAT2 knockout), "S-D1-D2" (DGAT1 and DGAT2 knockout), "S-P-D1" (PDAT and DGAT1 knockout), "S-P-D2" (PDAT and DGAT2 knockout) and "S-P-D1-D2" (PDAT, DGAT1 and DGAT2 knockout). Abbreviations utilized are: "WT"=wildtype; "FAs"=fatty acids; "dcw"=dry cell weight; and, "FAs % dcw, % WT"=FAs % dcw relative to the % in wildtype, wherein the "S" strain is wildtype.

TABLE 58

Lipid Content In *Yarrowia* ATCC #90812 Strains With Single, Double, Or Triple Disruptions In PDAT, DGAT2 And DGAT1

|  |  |  | Total Fatty Acids | | | TAG Fraction | | |
|---|---|---|---|---|---|---|---|---|
| Strain | Residual DAG AT | dcw, mg | FAs, μg | FAs % dcw | FAs % dcw, % WT | FAs, μg | FAs % dcw | FAs % dcw, % WT |
| S | D1, D2, P | 32.0 | 797 | 15.9 | 100 | 697 | 13.9 | 100 |
| S-D1 | D2, P | 78.8 | 723 | 13.6 | 86 | 617 | 11.6 | 83 |
| S-D2 | D1, P | 37.5 | 329 | 6.4 | 40 | 227 | 4.4 | 32 |
| S-P | D1, D2 | 28.8 | 318 | 6.0 | 38 | 212 | 4.0 | 29 |
| S-D1-D2 | P | 64.6 | 219 | 4.1 | 26 | 113 | 2.1 | 15 |
| S-D1-P | D2 | 76.2 | 778 | 13.4 | 84 | 662 | 11.4 | 82 |
| S-D2-P | D1 | 31.2 | 228 | 4.3 | 27 | 122 | 2.3 | 17 |
| S-D1-D2-P | None | 52.2 | 139 | 2.4 | 15 | 25 | 0.4 | 3 |

The results in Table 58 indicate the relative contribution of the three DAG ATs to oil biosynthesis. DGAT2 contributes the most, while PDAT and DGAT1 contribute equally but less than DGAT2. The residual oil content ca. 3% in the triple knockout strain may be the contribution of *Yarrowia lipolytica*'s acyl-CoA:sterol-acyltransferase enzyme, encoded by ARE2 (SEQ ID NOs:91 and 92).

TAG Content is Decreased and Percent EPA is Increased in *Yarrowia Lipolytica* Strain EU with a Disrupted DGAT2 Gene After examining the affect of various acyltransferase knockouts in wildtype *Y. lipolytica* ATCC #90812 (supra), TAG content and fatty acid composition was then studied in DGAT2 knockout strains of the EU strain (i.e., engineered to produce 10% EPA; see Example 4).

Specifically, the DGAT2 gene in strain EU was disrupted as described for the S strain (ATCC #90812) in Example 29. The DGAT2-disrupted strain was designated EU-D2. EU and EU-D2 strains were harvested and analyzed following growth according to two different conditions. In the condition referred to in the Table below as "3 mL", cells were grown for 1 day in 3 mL MM medium, washed and then grown for 3 days in 3 mL HGM. Alternatively, in the condition referred to in the Table below as "51 mL", cells were grown for 1 day in 51 mL MM medium, washed and then grown for 3 days in 51 mL HGM. The fatty acid compositions of phosphatidylcholine (PC), phosphatidyletanolamine (PE), and triacylglycerol (TAG or oil) were determined in the extracts of 51 mL cultures following TLC separation ("Fraction").

GC results are shown below in Table 59. Cultures are described as the "EU" strain (wildtype) and the "EU-D2" strain (DGAT2 knockout). Fatty acids are identified as 16:0, 16:1, 18:0, 18:1 (oleic acid), 18:2 (LA), GLA, DGLA, ARA, ETA and EPA; and the composition of each is presented as a % of the total fatty acids.

TABLE 59

Lipid Content And Composition In *Yarrowia* Strain EU With Disruption In DGAT2

| Strain & Growth | Fraction | TFAs % dcw | % 16:0 | % 16:1 | % 18:0 | % 18:1 | % 18:2 | % GLA | % DGLA | % ARA | % ETA | % EPA |
|---|---|---|---|---|---|---|---|---|---|---|---|---|
| EU, 3 mL | Total |  | 19 | 10 | 2 | 16 | 12 | 19 | 6 | 0 | 3 | 10 |
| EU-D2, 3 mL | Total |  | 17 | 10 | 1 | 6 | 7 | 24 | 5 | 0 | 6 | 19 |
| EU, 51 mL | Total | 37 | 18 | 11 | 3 | 19 | 31 | 5 | 1 |  | 1 | 4 |
|  | PC | 2 | 12 | 9 | 1 | 8 | 43 | 7 | 3 |  | 5 | 4 |
|  | PE | 1 | 24 | 14 | 0 | 14 | 37 | 5 | 0 |  | 0 | 1 |
|  | TAG | 34 | 18 | 12 | 3 | 21 | 29 | 5 | 1 |  | 1 | 4 |
| EU-D2, 51 mL | Total | 18 | 18 | 8 | 1 | 5 | 7 | 25 | 5 |  | 5 | 20 |
|  | PC | 1 | 18 | 6 | 1 | 2 | 4 | 26 | 5 |  | 11 | 22 |
|  | PE | 1 | 25 | 7 | 0 | 2 | 5 | 14 | 2 |  | 3 | 8 |
|  | TAG | 15 | 16 | 9 | 1 | 6 | 5 | 26 | 6 |  | 5 | 21 |

The results show that the DGAT2 knockout resulted in doubling of the % EPA (of total fatty acids) and halving of the lipid content (as % dcw). Furthermore, almost all of the changes observed in the lipid content are due to changes in the TAG fraction. The lower than expected % EPA in the 51 mL culture of strain EU is likely due to instability.

TAG Content is Decreased and Percent EPA is Increased in *Yarrowia lipolytica* Strain MU with Disrupted Acyltransferase Genes Finally, based on the increased % EPA and reduced lipid content resulting from a single DGAT2 knockout in strain EU-D2, TAG content and fatty acid composition was then studied in various acyltransferase knockout strains of strain MU (engineered to produce 14% EPA; see Example 12). Specifically, single disruptions in PDAT, DGAT2 and DGAT1 and double disruptions in PDAT and DGAT2 were created in strain MU. Lipid content and composition was compared in each of these strains, following growth in 4 different growth conditions.

More specifically, single disruptions in PDAT, DGAT2, DGAT1 were created in strain MU, using the methodology described in Example 29 (with the exception that selection for the DGAT1 disruption relied on the URA3 gene). This resulted in single knockout strains identified as "MU-D1" (disrupted in DGAT1), "MU-D2" (disrupted in DGAT2), and "MU-P" (disrupted in PDAT). Individual knockout strains were confirmed by PCR. Additionally, the MU-D2 strain was disrupted for the PDAT gene by the same method and the disruption confirmed by PCR. The resulting double knockout strain was designated "MU-D2-P".

The MU-D1, MU-D2, MU-P, and M-D2-P knockout strains were analyzed to determine each knockout's effect on lipid content and composition, as described below. Furthermore, the growth conditions promoting oleaginy were also explored to determine their effect on total lipid content. Thus, in total, four different experiments were conducted, identified as "Experiment A", "Experiment B", "Experiment C" and "Experiment E". Specifically, three loops of cells from plates containing each strain above was inoculated into MMU medium [3 mL for Experiments B and C; and 50 mL for Experiments A and E] and grown in a shaker at 30° C. for 24 hrs (for Experiments A, B and C) or 48 hrs (for Experiment E). Cells were harvested, washed once in HGM, resuspended in either HGM medium (50 mL for Experiments A and E; and 3 mL for Experiment B) or HGM medium with uracil ("HGMU") (3 mL for Experiment C) and cultured as above for 4 days. One aliquot (1 mL) was used for lipid analysis by GC as described according to the General Methods, while a second aliquot was used for determining the culture OD at 600 nm. The remaining culture in Experiments A and E was harvested, washed once in water, and lyophilized for dry cell weight (dcw) determination. In contrast, the dcw in Experiments B and C were determined from their $OD_{600}$ using the equation showing their relationship. The fatty acid compositions of each of the different strains in Experiments A, B, C and E was also determined.

The results are shown in Table 60 below. Cultures are described as the "MU" strain (the parent EPA producing strain), "MU-P" (PDAT knockout), "MU-D1" (DGAT1 knockout), "MU-D2" (DGAT2 knockout) and "MU-D2-P" (DGAT2 and PDAT knockouts). Abbreviations utilized are: "WT"=wildtype (i.e., MU); "OD"=optical density; "dcw"=dry cell weight; "TFAs"=total fatty acids; and, "TFAs % dcw, % WT"=TFAs % dcw relative to the wild type ("MU") strain. Fatty acids are identified as 16:0, 16:1, 18:0, 18:1 (oleic acid), 18:2 (LA), GLA, DGLA, ARA, ETA and EPA; and the composition of each is presented as a % of the total fatty acids.

TABLE 60

Lipid Content And Composition In *Yarrowia* Strain MU With Various Acyltransferase Disruptions

| Expt | Strain | Residual DAG AT | 1st Phase Growth Condition | 2nd Phase Growth Condition | OD | dcw (mg) | TFAs (µg) | TFAs % dcw | TFAs % dcw, % WT |
|---|---|---|---|---|---|---|---|---|---|
| A | MU | D1, D2, P | 1 day, | 4 days, | 4.0 | 91 | 374 | 20.1 | 100 |
| A | MU-D2 | D1, P | 50 mL | 50 mL | 3.1 | 75 | 160 | 10.4 | 52 |
| A | MU-D1 | D2, P | MMU | HGM | 4.3 | 104 | 217 | 10.2 | 51 |
| A | MU-P | D1, D2 | | | 4.4 | 100 | 238 | 11.7 | 58 |
| B | MU | D1, D2, P | 1 day, | 4 days, | 5.9 | 118 | 581 | 24.1 | 100 |
| B | MU-D2 | D1, P | 3 mL | 3 mL | 4.6 | 102 | 248 | 11.9 | 50 |
| B | MU-D1 | D2, P | MMU | HGM | 6.1 | 120 | 369 | 15.0 | 62 |
| B | MU-P | D1, D2 | | | 6.4 | 124 | 443 | 17.5 | 72 |
| C | MU | D1, D2, P | 1 day, | 4 days, | 6.8 | 129 | 522 | 19.9 | 100 |
| C | MU-D2 | D1, P | 3 mL | 3 mL | 5.6 | 115 | 239 | 10.2 | 51 |
| C | MU-D1 | D2, P | MMU | HGMU | 6.9 | 129 | 395 | 15.0 | 75 |
| C | MU-P | D1, D2 | | | 7.1 | 131 | 448 | 16.8 | 84 |
| E | MU | D1, D2, P | 2 days, | 4 days, | 4.6 | 89 | 314 | 17.3 | 100 |
| E | MU-D2 | D1, P | 50 mL | 50 mL | 2.8 | 62 | 109 | 8.5 | 49 |
| E | MU-P | D2, P | MM | HGM | 5.0 | 99 | 232 | 11.5 | 66 |
| E | MU-D2-P | D1 | | | 4.2 | 98 | 98 | 4.9 | 28 |

| Expt | % 16:0 | % 16:1 | % 18:0 | % 18:1 | % 18:2 | % GLA | % DGLA | % ARA | % ETA | % EPA |
|---|---|---|---|---|---|---|---|---|---|---|
| A | 17 | 10 | 2 | 18 | 10 | 22 | 7 | 1 | 3 | 9.7 |
| A | 16 | 12 | 0 | 8 | 9 | 23 | 7 | 0 | 8 | 17.4 |
| A | 15 | 10 | 2 | 11 | 10 | 22 | 7 | 0 | 7 | 17.4 |
| A | 16 | 9 | 2 | 11 | 7 | 24 | 7 | 1 | 6 | 17.5 |
| B | 17 | 9 | 3 | 18 | 10 | 22 | 8 | 1 | 3 | 9.1 |
| B | 16 | 10 | 0 | 7 | 10 | 24 | 7 | 1 | 7 | 17.8 |
| B | 18 | 9 | 3 | 14 | 11 | 20 | 7 | 1 | 5 | 12.0 |
| B | 15 | 8 | 3 | 16 | 10 | 25 | 6 | 1 | 4 | 11.9 |
| C | 16 | 10 | 2 | 13 | 11 | 21 | 10 | 1 | 4 | 12.6 |
| C | 17 | 9 | 1 | 6 | 11 | 21 | 8 | 1 | 7 | 18.9 |
| C | 15 | 9 | 2 | 12 | 12 | 20 | 10 | 1 | 5 | 13.5 |
| C | 17 | 8 | 3 | 14 | 11 | 20 | 10 | 1 | 4 | 11.3 |
| E | 16 | 12 | 2 | 18 | 9 | 22 | 7 | 1 | 4 | 11.2 |
| E | 14 | 12 | 1 | 6 | 8 | 25 | 6 | 0 | 7 | 20.0 |
| E | 16 | 10 | 2 | 14 | 7 | 24 | 7 | 1 | 5 | 15.8 |
| E | 18 | 10 | 0 | 7 | 12 | 20 | 5 | 0 | 6 | 22.5 |

The data showed that the lipid content within the transformed cells varied according to the growth conditions. Furthermore, the contribution of each acyltransferase on lipid content also varied. Specifically, in Experiments B, C and E, DGAT2 contributed more to oil biosynthesis than either PDAT or DGAT1. In contrast, as demonstrated in Experiment A, a single knockout in DGAT2, DGAT1 and PDAT resulted in approximately equivalent losses in lipid content (i.e., 48%, 49% and 42% loss, respectively [see "TFAs % dcw, % WT"]).

With respect to fatty acid composition, the data shows that knockout of each individual DAG AT gene resulted in lowered oil content and increased % EPA. For example, the DGAT2 knockout resulted in about half the lipid content and ca. double the % EPA in total fatty acids (similar to the results observed in strain EU-D2, supra). Knockout of both DAGAT2 and PDAT resulted in the least oil and the most % EPA.

On the basis of the results reported herein, it is contemplated that disruption of the native DGAT2 and/or DGAT1 and/or PDAT is a useful means to substantially increase the % PUFAs in a strain of Yarrowia lipolytica engineered to produce high concentrations of PUFAs, including EPA (e.g., within strains Y2088, Y2089, Y2090, Y2095, Y2096, Y2102, Y2201 and/or Y2203). In fact, a disruption of the native DGAT2 gene in Y. lipolytica strain Y2214 (producing 14% ARA via the Δ9 elongase/Δ8 desaturase pathway; the final genotype of this strain with respect to wildtype Y. lipolytica ATCC #20362 was as follows: Aco2-, Lys5-, 2×GPAT::IgD9e::PEX20, 2X TEF::IgD9e::LIP1, FBAINm::IgD9e::OCT, 2X FBAIN::D8SF::PEX16, GPD::D8SF::PEX16, GPAT::MAΔ5::PEX20, FBAIN::MAΔ5::PEX20, YAT1::I.D5S::LIP1, GPM/FBAIN::I. D5S::OCT, FBAIN::F.D12S::PEX20 and GPM/FBAIN::rELO2S::OCT) resulted in a 1.7 fold increase in the percent ARA (data not shown).

SEQUENCE LISTING (414 sequences)

SEQ ID NO: 1 - DNA, 1374 bp, Mortierella alpina AF465281
  misc_feature: delta-6 desaturase
atggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaa

SEQ ID NO: 2 - protein, 457 aa, Mortierella alpina AF465281
MAAAPSVRTFTRAEVLNAEALNEGKKDAEAPFLMIIDNKVYDVREFVPDHPGGSVILTHVGKDGTDVFDTFHPEAAWETLANFYVGDIDESDRDIKNDDFAAEVRKLRTLFQSLGYYDSSKAYYAFKVSFNLCIWGLSTVIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMLVYFLVSQAVCGNLLAIVFSLNHNGMPVISKEEAVDMDFFTKQIITGRDVHPGLFANWFTGGLNYQIEHHLFPSMPRHNFSKIQPAVETLCKKYNVRYHTTGMIEGTAEVFSRLNEVSKATSKMGKAQ

SEQ ID NO: 3 - DNA, 1374 bp, Mortierella alpina
  misc_feature: synthetic delta-6 desaturase (codon-optimized)
atggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaa

SEQ ID NO: 4 - DNA, 1521 bp, Mortierella alpina (GenBank Accession No. AB070555)
  misc_feature: delta-6 desaturase
acaacgtgctcttgtcctcagaagactgttgtgctcttccttccaccaccccaagcactctctcaccccaagcactgcctgccatgaccaccagcgacccatctgtcagagcgttcacacgctcagaagtgttgcacgccgatgccttgaacgagggcaaaaagaacgccgaggcaccgtttctcatgatcatcgacaacaaggtctacgatgtgcgcgagtttatccccgaccatcctggtgggagcgtcattttgacccacgtaggcaaggacggcaccgacgttttcgagaccttccatcctgaggctgcttgggagacgctcgccaatttttatgtcggtgacattgtagaatccgatcgcgccatcgagaacgacgagtttgcagctgaggttcgtaagctgcggacattgttttattctttgggctactacgactcatccaaggtttactacgccttcaaggtctcgttcaacctctgcatctggggcctgtctgcattcattgttgccaaatggggccagacctcgaccctcgcaaacgtgatatcagcctcactcctgggtgtcttttggcaacagtgcggttggctcgcccatgatttcttgcaccatcaggtctttcacgatcgattctggggcgatctgttcggtgcatttctcggcggagtctgtcaaggtttctcctcgtcctggtggaaggacaaacacaacacccaccacgcggcgcccaatgtccatggagaggatcccgatatcgacacacatccgcttttgacgtggagtgagcatgcgctcgagatgttttcggatgtgcccgatgaggagcttacccaaatgtggtcccggtttatggttctgaaccaggcctggttttactttcccattctgtcatttgcccgcctgtcctggtgcatccagtcgattctttttgtgctaccgaacggacaggcacacaaacctgcgggggctcgggttcccatctcgctggtggagcaattgtcgttggcgatgcactggacctggtacctggcaaccatgttcctgttcatcaaggatcccgtcaacatgatggtgtatttcttggtctcgcaagctgtctgcggcaacctgttagcgattgtgttctcgctgaaccataacggtatgcctgtgatctcgcaggaggaagcggtcgagatggatttcttcacaaagcagatcattacgggtcgtgatgtctacccgggttggtttgcagactggttcacgggtggattgaactatcagattgaacaccatctgttcccgtcgatgcctcgacaccatttctcaaagatccagcccgcggttgaatcgctgtgcaagaagtacggggtccgataccatacgacggggatgattgctggcaccgcagaggtcttttcgcgactgaacgaggtgtcccaggctgcaagcaagctcggcaagtctgcttgagtctttcatgtcctcaagttgattctagatacttattttcgcagacttctatcgataaatt

SEQ ID NO: 5 - protein, 458 aa, Mortierella alpina (GenBank Accession No. AB070555)
MTTSDPSVRAFTRSEVLHADALNEGKKNAEAPFLMIIDNKVYDVREFIPDHPGGSVILTHVGKDGTDVFETFHPEAAWETLANFYVGDIVESDRAIENDEFAAEVRKLRTLFYSLGYYDSSKVYYAFKVSFNLCIWGLSAFIVAKWGQTSTLANVISASLLGVFWQQCGWLAHDFLHHQVFHDRFWGDLFGAFLGGVCQGFSSSWWKDKHNTHHAAPNVHGEDPDIDTHPLLTWSEHALEMFSDVPDEELTQMWSRFMVLNQAWFYFPILSFARLSWCIQSILFVLPNGQAHKPAGARVPISLVEQLSLAMHWTWYLATMFLFIKDPVNMMVYFLVSQAVCGNLLAIVFSLNHNGMPVISQEEAVEMDFFTKQIITGRDVYPGWFADWFTGGLNYQIEHHLFPSMPRHHFSKIQPAVESLCKKYGVRYHTTGMIAGTAEVFSRLNEVSQAASKLGKSA

SEQ ID NO: 6 - DNA, 1341 bp, Mortierella alpina AF067654
  misc_feature: delta-5 desaturase
atgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtag

SEQ ID NO: 7 - protein, 446 aa, Mortierella alpina AF067654
MGTDQGKTFTWEELAAHNTKDDLLLAIRGRVYDVTKFLSRHPGGVDTLLLGAGRDVTPVFEMYHAFGAADAIMKKYYVGTLVSNELPIFPEPTVFHKTIKTRVEGYFTDRNIDPKNRPEIWGRYALIFGSLIASYYAQLFVPFVVERTWLQVVFAIIMGFACAQVGLNPLHDASHFSVTHNPTVWKILGATHDFFNGASYLVWMYQHMLGHHPYTNIAGADPDVSTSEPDVRRIKPNQKWFVNHINQHMFVPFLYGLLAFKVRIQDINILYFVKTNDAIRVNPISTWHTVMFWGGKAFFVWYRLIVPLQYLPLGKVLLLFTVADMVSSYWLALTFQANHVVEEVQWPLPDENGIIQKDWAAMQVETTQDYAHDSHLWTSITGSLNYQAVHHLFPNVSQHHYPDILAIIKNTCSEYKVPYLVKDTFWQAFASHLEHLRVLGLRPKEE

SEQ ID NO: 8 - DNA, 1329 bp, Isochrysis galbana CCMP1323
  misc_feature: delta-5 desaturase
atggtggcaggcaaatcaggcgctgcggcgcacgtgactcacagctcgacattgccccgtgagtaccatggcgcgaccaacgactcgcgctctgaggcggccgacgtcaccgtctctagcatcgatgctgaaaaggagatgatcatcaacggccgcgtgtatgacgtgtcgtcatttgtgaagcggcacccaggtggctcggtgatcaagttccagctgggcgccgacgcgagcgacgcgtacaacaactttcacgtccgctccaagaaggcggacaagatgctgtattcgctcccgtcccggccggccgaggccggctacgcccaggacgacatctcccgcgactttgagaagctgcgcctcgagctgaaggaggagggctacttcgagcccaacctggtgcacgtgagctacaggtgtgtggaggttcttgccatgtactgggctggcgtccagctcatctggtccgggtactggttcctcggcgcgatcgtggccggcattgcgcagggccgctgcggctggctccagcatgagggtgggcactactcgctcaccggcaacatcaagatcgaccggcatctgcagatggccatctatgggcttggctgcggcatgtcgggctgctactggcgcaaccagcacaacaagcaccacgccacgccgcagaagctcgggaccgaccccgacctgcagacgatgccgctggtggccttccacaagatcgtcggcgccaaggcgcgaggcaagggcaaggcgtggctggcgtggcaggcgccgctcttctttggcgggatcatctgctcgctcgtctctttcggctggcagttcgtgctccaccccaaccacgcgctgcgcgtgcacaatcacctggagctcgcgtacatgggcctgcggtacgtgctgtggcacctggcctttggccacctcgggctgctgagctcgctccgcctgtacgccttttacgtggccgtgggcggcacctacatcttcaccaacttcgccgtctcgcacacccacaaggacgtcgtcccgcccaccaagcacatctcgtgggcactctactcggccaaccacacgaccaactgctccgactcgccctttgtcaactggtggatggcctacctcaacttccagatcgagcaccacctcttcccgtcgatgccgcagtacaaccaccccaagatcgccccgcgggtgcgcgcgctcttcgagaagcacggggtcgagtatgacgtccggccatacctggagtgttttcgggtcacgtacgtcaacctgctcgccgtaggcaacccggagcactcctaccacgagcacacgcactag

SEQ ID NO: 9 - protein, 442 aa, Isochrysis galbana CCMP1323
MVAGKSGAAAHVTHSSTLPREYHGATNDSRSEAADVTVSSIDAEKEMIINGRVYDVSSFVKRHPGGSVIKFQLGADASDAYNNFHVRSKKADKMLYSLPSRPAEAGYAQDDISRDFEKLRLELKEEGYFEPNLVHVSYRCVEVLAMYWAGVQLIWSGYWFLGAIVAGIAQGRCGWLQHEGGHYSLTGNIKIDRHLQMAIYGLGCGMSGCYWRNQHNKHHATPQKLGTDPDLQTMPLVAFHKIVGAKARGKGKAWLAWQAPLFFGGIICSLVSFGWQFVLHPNHALRVHNHLELAYMGLRYVLWHLAFGHLGLLSSLRLYAFYVAVGGTYIFTNFAVSHTHKDVVPPTKHISWALYSANHTTNCSDSPFVNWWMAYLNFQIEHHLFPSMPQYNHPKIAPRVRALFEKHGVEYDVRPYLECFRVTYVNLLAVGNPEHSYHEHTH

SEQ ID NO: 10 - DNA, 1329 bp, Isochrysis galbana
  misc_feature: synthetic delta-5 desaturase (codon-optimized)
atggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaa

SEQ ID NO: 11 - DNA, 1335 bp, Homo sapiens
  misc_feature: delta-5 desaturase
atggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggatccctttgtggccttccacatcaacaagggccttgtgaagaagtatatgaactctctcctgattggagaactgtctccagagcagcccagctttgagcccaccaagaataaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggcccaggctggctggctgcagcatgactttgggcacctgtcggtcttcagcacctcaaagtggaaccatctgctacatcattttgtgattggccacctgaagggggcccccgccagttggtggaaccacatgcacttccagcaccatgccaagcccaactgcttccgcaaagacccagacatcaacatgcatcccttcttctttgccttggggaagatcctctctgtggagcttgggaaacagaagaaaaaatatatgccgtacaaccaccagcacaaatacttcttcctaattgggcccccagccttgctgcctctctacttccagtggtatattttctattttgttatccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacatggactgggtttccacccagctccaggccacatgcaatgtccacaagtctgccttcaatgactggttcagtggacacctcaacttccagattgagcaccatctttttcccacgatgcctcgacacaattaccacaaagtggctcccctggtgcagtccttgtgtgccaagcatggcatagagtaccagtccaagcccctgctgtcagccttcgccgacatcatccactcactaaaggagtcagggcagctctggctagatgcctatcttcaccaataa

SEQ ID NO: 12 - protein, 444 aa, Homo sapiens
MAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 13 - DNA, 1335 bp, Homo sapiens
  misc_feature: synthetic delta-5 desaturase (codon-optimized)
atggctcccgaccctgtcgctgccgagaccgctgcccagggtcccactccccgatacttcacctgggacgaggtcgcccagcgatccggttgcgaggaacgatggctggtcatcgaccgaaaggtgtacaacatctctgagttcacccgacgacatcccggtggctcccgagtgatctcgcactacgctggacaggacgccactgaccccttcgttgcctttcacattaacaagggcctggttaagaagtacatgaactccctgctcattggagagctgtctcccgaacagccttcgtttgagcctaccaagaacaaggagctgaccgacgagtttcgagagctccgagccaccgttgagcgaatgggactgatgaaggccaaccatgtcttctttctgctctacctgctccacattcttctccttgacggagctgcctggcttaccctgtgggtcttcggcacttcctttctgccctttcttctctgcgccgtcctgctctctgccgtgcaggctcaggctggttggcttcagcatgactttggtcacctttccgtgttctctacctccaagtggaaccacctgctccatcacttcgtgatcggccacctcaagggtgctcctgcctcgtggtggaaccacatgcatttccagcaccatgccaagcccaactgttttcgaaaggatcccgacatcaacatgcaccccttctttttcgctcttggcaagatcctgtccgtcgagctcggaaagcagaagaagaagtacatgccctacaaccaccagcacaagtacttcttcctgattggacctcccgctctcctgcctctttactttcagtggtacatcttttactttgttattcagcgaaagaagtgggttgatcttgcctggatgatcaccttctacgtccgattcttcctgacctacgtccctctccttggactgaaggcctttctcggtctgttctttatcgtccgattcctggagtccaactggttcgtgtgggtgacccagatgaaccacattcccatgcacattgaccatgatcgaaacatggactgggtgtcgactcagctgcaggccacctgcaacgttcacaagtctgctttcaacgactggttttccggtcacctcaactttcagattgagcaccatctgtttcccaccatgcctcgacacaactaccacaaggttgctcccctggtccagtcgctctgtgccaagcatggcatcgagtaccagtccaagcccctgctctctgccttcgctgacatcattcactcgctgaaggaatctggccagctctggctcgatgcctacctgcaccagtaa

SEQ ID NO: 14 - DNA, 1077 bp, Saprolegnia diclina (ATCC #56851)
  misc_feature: delta-17 desaturase
atgactgaggataagacgaaggtcgagttcccgacgctcacggagctcaagcactcgatcccgaacgcgtgctttgagtcgaacctcggcctctcgctctactacacggcccgcgcgatcttcaacgcgtcggcctcggcggcgctgctctacgcggcgcgctcgacgccgttcattgccgataacgttctgctccacgcgctcgtttgcgccacctacatctacgtgcagggcgtcatcttctggggcttcttcacggtcggccacgactgcggccactcggccttctcgcgctaccacagcgtcaactttatcatcggctgcatcatgcactctgcgattttgacgccgttcgagagctggcgcgtgacgcaccgccaccaccacaagaacacgggcaacattgataaggacgagatcttttacccgcaccggtcggtcaaggacctccaggacgtgcgccaatgggtctacacgctcggcggtgcgtggtttgtctacttgaaggtcgggtatgccccgcgcacgatgagccactttgacccgtgggacccgctcctccttcgccgcgcgtcggccgtcatcgtgtcgctcggcgtctgggccgccttcttcgccgcgtacgcgtacctcacatactcgctcggctttgccgtcatgggcctctactactatgcgccgctctttgtctttgcttcgttcctcgtcattacgaccttcttgcaccacaacgacgaagcgacgccgtggtacggcgactcggagtggacgtacgtcaagggcaacctctcgagcgtcgaccgctcgtacggcgcgttcgtggacaacctgagccaccacattggcacgcaccaggtccaccacttgttcccgatcattccgcactacaagctcaacgaagccaccaagcactttgcggccgcgtacccgcacctcgtgcgcaggaacgacgagcccatcatcacggccttcttcaagaccgcgcacctctttgtcaactacggcgctgtgcccgagacggcgcagatcttcacgctcaaagagtcggccgcggccgccaaggccaagtcggactaa

SEQ ID NO: 15 - protein, 358 aa, Saprolegnia diclina (ATCC #56851)
MAEDKTKVEFPTLTELKHSIPNACFESNLGLSLYYTARAIFNASASAALLYAARSTPFIADNVLLHALVCATYIYVQGVIFWGFFTVGHDCGHSAFSRYHSVNFIIGCIMHSAILTPFESWRVTHRHHHKNTGNIDKDEIFYPHRSVKDLQDVRQWVYTLGGAWFVYLKVGYAPRTMSHFDPWDPLLLRRASAVIVSLGVWAAFFAAYAYLTYSLGFAVMGLYYYAPLFVFASFLVITTFLHHNDEATPWYGDSEWTYVKGNLSSVDRSYGAFVDNLSHHIGTHQVHHLFPIIPHYKLNEATKHFAAAYPHLVRRNDEPIITAFFKTAHLFVNYGAVPETAQIFTLKESAAAAKAKSD

SEQ ID NO: 16 - DNA, 1077 bp, Saprolegnia diclina
  misc_feature: synthetic delta-17 desaturase (codon-optimized)
atggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaa

SEQ ID NO: 17 - DNA, 957 bp, Mortierella alpina AX464731
  misc_feature: elongase
atggagtcgattgcgccattcctcccatcaaagatgccgcaagatctgtttatggaccttgccaccgctatcggtgtccgggccgcgccctatgtcgatcctctcgaggccgcgctggtggcccaggccgagaagtacatccccacgattgtccatcacacgcgtgggttcctggtcgcggtggagtcgcctttggcccgtgagctgccgttgatgaacccgttccacgtgctgttgatcgtgctcgcttatttggtcacggtctttgtgggcatgcagatcatgaagaactttgagcggttcgaggtcaagacgttttcgctcctgcacaacttttgtctggtctcgatcagcgcctacatgtgcggtgggatcctgtacgaggcttatcaggccaactatggactgtttgagaacgctgctgatcataccttcaagggtcttcctatggccaagatgatctggctcttctacttctccaagatcatggagtttgtcgacaccatgatcatggtcctcaagaagaacaaccgccagatctccttcttgcacgtttaccaccacagctccatcttcaccatctggtggttggtcacctttgttgcacccaacggtgaagcctacttctctgctgcgttgaactcgttcatccatgtgatcatgtacggctactacttcttgtcggccttgggcttcaagcaggtgtcgttcatcaagttctacatcacgcgctcgcagatgacacagttctgcatgatgtcggtccagtcttcctgggacatgtacgccatgaaggtccttggccgccccggataccccttcttcatcacggctctgctttggttctacatgtggaccatgctcggtctcttctacaacttttacagaaagaacgccaagttggccaagcaggccaaggccgacgctgccaaggagaaggcaaggaagttgcagtaa

SEQ ID NO: 18 - protein, 318 aa, Mortierella alpina AX464731
MESIAPFLPSKMPQDLFMDLATAIGVRAAPYVDPLEAALVAQAEKYIPTIVHHTRGFLVAVESPLARELPLMNPFHVLLIVLAYLVTVFVGMQIMKNFERFEVKTFSLLHNFCLVSISAYMCGGILYEAYQANYGLFENAADHTFKGLPMAKMIWLFYFSKIMEFVDTMIMVLKKNNRQISFLHVYHHSSIFTIWWLVTFVAPNGEAYFSAALNSFIHVIMYGYYFLSALGFKQVSFIKFYITRSQMTQFCMMSVQSSWDMYAMKVLGRPGYPFFITALLWFYMWTMLGLFYNFYRKNAKLAKQAKADAAKEKARKLQ

SEQ ID NO: 19 - DNA, 957 bp, Mortierella alpina
  misc_feature: synthetic elongase 1 (codon-optimized)
atggagtccattgctcccttcctgccctccaagatgcctcaggacctgttcatggacctcgccagcgctatcggtgtccgagctgctccctacgtcgatcccctggaggctgccctggttgcccaggccgagaagtacattcccaccattgtccatcacactcgaggcttcctggttgccgtggagtctcccctggctcgagagctgcctctgatgaaccccttccacgtgctcctgatcgtgctcgcctacctggtcaccgtgtttgtgggtatgcagatcatgaagaactttgaacgattcgaggtcaagaccttctccctcctgcacaacttctgtctggtctccatctccgcctacatgtgcggtggcatcctgtacgaggcttatcaggccaactatggactgtttgagaacgctgccgatcacaccttcaagggtctccctatggctaagatgatctggctcttctacttctccaagatcatggagtttgtcgacaccatgatcatggtcctcaagaagaacaaccgacagatttcctttctgcacgtgtaccaccactcttccatcttcaccatctggtggctggtcaccttcgttgctcccaacggtgaagcctacttctctgctgccctgaactccttcatccacgtcatcatgtacggctactactttctgtctgccctgggcttcaagcaggtgtcgttcatcaagttctacatcactcgatcccagatgacccagttctgcatgatgtctgtccagtcttcctgggacatgtacgccatgaaggtccttggccgacctggataccccttcttcatcaccgctctgctctggttctacatgtggaccatgctcggtctcttctacaacttttaccgaaagaacgccaagctcgccaagcaggccaaggctgacgctgccaaggagaaggccagaaagctccagtaa

SEQ ID NO: 20 - DNA, 819 bp, Thraustochytrium aureum
  misc_feature: elongase 2
atggcaaacagcagcgtgtgggatgatgtggtgggccgcgtggagaccggcgtggaccagtggatggatggcgccaagccgtacgcactcaccgatgggctcccgatgatggacgtgtccaccatgctggcattcgaggtgggatacatggccatgctgctcttcggcatcccgatcatgaagcagatggagaagccttttgagctcaagaccatcaagctcttgcacaacttgtttctcttcggactttccttgtacatgtgcgtggagaccatccgccaggctatcctcggaggctacaaagtgtttggaaacgacatggagaagggcaacgagtctcatgctcagggcatgtctcgcatcgtgtacgtgttctacgtgtccaaggcatacgagttcttggataccgccatcatgatcctttgcaagaagttcaaccaggtttccttcttgcatgtgtaccaccatgccaccatttttgccatctggtgggctatcgccaagtacgctccaggaggtgatgcgtacttttcagtgatcctcaactctttcgtgcacaccgtcatgtacgcatactacttcttctcctcccaagggttcgggttcgtgaagccaatcaagccgtacatcaccacccttcagatgacccagttcatggcaatgcttgtgcagtccttgtacgactacctcttcccatgcgactacccacaggctcttgtgcagctccttggagtgtacatgatcaccttgcttgccctcttcggcaacttttttgtgcagagctatcttaaaaagccaaaaaagagcaagaccaactaa

SEQ ID NO: 21 - protein, 272 aa, Thraustochytrium aureum
MANSSVWDDVVGRVETGVDQWMDGAKPYALTDGLPMMDVSTMLAFEVGYMAMLLFGIPIMKQMEKPFELKTIKLLHNLFLFGLSLYMCVETIRQAILGGYKVFGNDMEKGNESHAQGMSRIVYVFYVSKAYEFLDTAIMILCKKFNQVSFLHVYHHATIFAIWWAIAKYAPGGDAYFSVILNSFVHTVMYAYYFFSSQGFGFVKPIKPYITTLQMTQFMAMLVQSLYDYLFPCDYPQALVQLLGVYMITLLALFGNFFVQSYLKKPKKSKTN

SEQ ID NO: 22 - DNA, 819 bp, Thraustochytrium aureum
  misc_feature: synthetic elongase (codon-optimized)
atggccaactcctctgtctgggacgacgtggtcggacgagtcgagaccggtgtcgaccagtggatggacggagctaagccctacgctctgaccgacggtctgcccatgatggacgtctccaccatgctcgccttcgaggtcggctacatggccatgctgctcttcggcattcccatcatgaagcagatggagaagcccttcgagctgaagaccatcaagctgctccacaacctgttcctcttcggactgtccctctacatgtgcgtcgagaccatccgacaggctatcctgggtggctacaaggtcttcggcaacgacatggagaagggcaacgagtcccacgctcagggcatgtcccgaatcgtctacgtgttctacgtctccaaggcctacgagttcctggacaccgctatcatgatcctgtgcaagaagttcaaccaggtctccttcctgcacgtgtaccaccatgccaccatcttcgccatctggtgggctattgccaagtacgctcctggtggcgacgcctacttctccgtcatcctcaactccttcgtccacaccgtcatgtacgcctactacttcttttcctctcagggcttcggcttcgtcaagcccatcaagccctacatcaccactctgcagatgacccagttcatggctatgctggtgcagtccctgtacgactacctcttcccctgcgactaccctcaggctctggtccagctgctcggcgtgtacatgatcaccctgctcgctctgttcggcaacttctttgtccagtcctacctgaagaagcccaagaagtccaagaccaactaa

SEQ ID NO: 23 - DNA, 1936 bp, Yarrowia lipolytica
  CDS (283)..(1539): delta-12 desaturase
cgtagttatatacaagaggtagatgcgtgctggtgttagaggggctctcaggattaggaggaaaatttgacattggccctcaacatataacctcgggtgtgcctctgtttaccctcagcttttgcttgtccccaagtcagtcacgccaggccaaaaaggttggtggattgacagggagaaaaaaaaaagcctagtgggtttaaactcgaggtaagacattgaaatatataccggtcggcatcctgagtccctttctcgtattccaacagaccgaccatagaaatggattcgaccacgcagaccaacaccggcaccggcaaggtggccgtgcagccccccacggccttcattaagcccattgagaaggtgtccgagcccgtctacgacacctttggcaacgagttcactcctccagactactctatcaaggatattctggatgccattccccaggagtgctacaagcggtcctacgttaagtcctactcgtacgtggcccgagactgcttctttatcgccgtttttgcctacatggcctacgcgtacctgcctcttattccctcggcttccggccgagctgtggcctgggccatgtactccattgtccagggtctgtttggcaccggtctgtgggttcttgcccacgagtgtggccactctgctttctccgactctaacaccgtcaacaacgtcaccggatgggttctgcactcctccatgctggtcccttactacgcctggaagctgacccactccatgcaccacaagtccactggtcacctcacccgtgatatggtgtttgtgcccaaggaccgaaaggagtttatggagaaccgaggcgcccatgactggtctgagcttgctgaggacgctcccctcatgaccctctacggcctcatcacccagcaggtgtttggatggcctctgtatctgctgtcttacgttaccggacagaagtaccccaagctcaacaaatgggctgtcaaccacttcaaccccaacgccccgctgtttgagaagaaggactggttcaacatctggatctctaacgtcggtattggtatcaccatgtccgtcatcgcatactccatcaaccgatggggcctggcttccgtcaccctctactacctgatcccctacctgtgggtcaaccactggctcgtggccatcacctacctgcagcacaccgaccccactctgccccactaccacgccgaccagtggaacttcacccgaggagccgccgccaccatcgaccgagagtttggcttcatcggctccttctgcttccatgacatcatcgagacccacgttctgcaccactacgtgtctcgaattcccttctacaacgcccgaatcgccactgagaagatcaagaaggtcatgggcaagcactaccgacacgacgacaccaacttcatcaagtctctttacactgtcgcccgaacctgccagtttgttgaaggtaaggaaggcattcagatgtttagaaacgtcaatggagtcggagttgctcctgacggcctgccttctaaaaagtagagctagaaatgttatttgattgtgttttaactgaacagcaccgagcccgaggctaagccaagcgaagccgaggggttgtgtagtccatggacgtaacgagtaggcgatatcaccgcactcggcactgcgtgtctgcgttcatgggcgaagtcacattacgctgacaaccgttgtagtttccctttagtatcaatactgttacaagtaccggtctcgtactcgtactgatacgaatctgtgggaagaagtcacccttatcagaccttcatactgatgtttcggatatcaatagaactggcatagagccgttaaagaagtttcacttaatcactccaaccctcctacttgtagattcaagcagatcgataagatggatttgatggtcagtgctagc

SEQ ID NO: 24 - protein, 419 aa, Yarrowia lipolytica
MDSTTQTNTGTGKVAVQPPTAFIKPIEKVSEPVYDTFGNEFTPPDYSIKDILDAIPQECYKRSYVKSYSYVARDCFFIAVFAYMAYAYLPLIPSASGRAVAWAMYSIVQGLFGTGLWVLAHECGHSAFSDSNTVNNVTGWVLHSSMLVPYYAWKLTHSMHHKSTGHLTRDMVFVPKDRKEFMENRGAHDWSELAEDAPLMTLYGLITQQVFGWPLYLLSYVTGQKYPKLNKWAVNHFNPNAPLFEKKDWFNIWISNVGIGITMSVIAYSINRWGLASVTLYYLIPYLWVNHWLVAITYLQHTDPTLPHYHADQWNFTRGAAATIDREFGFIGSFCFHDIIETHVLHHYVSRIPFYNARIATEKIKKVMGKHYRHDDTNFIKSLYTVARTCQFVEGKEGIQMFRNVNGVGVAPDGLPSKK

SEQ ID NO: 25 - DNA, 1203 bp, Mortieralla isabellina (GenBank Accession No. AF417245)
  CDS (1)..(1203): delta-12 desaturase
atggcacctcccaacactatcgatgccggcttgacccagcgtcatatcaccaccacggccgccccaacctcggccaagcccgctttcgagcgcaactaccagctccccgagttcactatcaaggagatccgagagtgcatccctgcccactgctttgagcgctccggtcttcgtggtctctgccacgttgccattgatctgacctgggcctcgctcttgttcctggctgcaacccagatcgacaagttcgagaaccccttgatccgctatctggcctggcctgcgtactggatcatgcagggcattgtctgcaccggcatatgggtgctggcccacgagtgcggtcaccagtccttctcgacctccaagactctcaacaacaccgtcggctggatcctgcactcgatgctcttggtcccctaccactcctggagaatctcgcactcgaagcaccacaaggccactggccacatgaccaaggaccaggtctttgttcccaagacccgctcccaggttggtttgcctcccaaggagagcgctgctgctgccgttcaagaggaggacatgtccgtgcacctggatgaggaggcccctattgtgactttgttctggatggtgatccagttcctgttcggatggcctgcatacctgatcatgaacgcctctggtcaggactatggccgctggacctcgcacttccacacttactcgcccatctttgagccccgcaacttcttcgacattatcatctcggatctcggtgtgttggctgccctcggtgccctgatctacgcttccatgcagctgtcgctcttgaccgtgaccaagtactacatcatcccgtacctgtttgtcaacttttggttggtcctgattactttcttgcagcacaccgaccccaagctgccccattaccgtgagggtgcctggaacttccagcgtggagccctctgcaccgttgaccgctcgtttggcaagttcttggaccatatgttccacggcatcgtccatacccatgtggcccatcacttgttctcgcagatgccgttctaccatgctgaagaagctacctaccatctcaagaaactgctgggagagtactacgtttacgacccatccccgatcgtcgttgcggtctggaggtcgttccgcgagtgccgattcgtggaggatcatggagacgtggtctttttcaagaagtaa

SEQ ID NO: 26 - protein, 400 aa, Mortieralla isabellina (GenBank Accession No. AF417245)
MAPPNTIDAGLTQRHITTTAAPTSAKPAFERNYQLPEFTIKEIRECIPAHCFERSGLRGLCHVAIDLTWASLLFLAATQIDKFENPLIRYLAWPAYWIMQGIVCTGIWVLAHECGHQSFSTSKTLNNTVGWILHSMLLVPYHSWRISHSKHHKATGHMTKDQVFVPKTRSQVGLPPKESAAAAVQEEDMSVHLDEEAPIVTLFWMVIQFLFGWPAYLIMNASGQDYGRWTSHFHTYSPIFEPRNFFDIIISDLGVLAALGALIYASMQLSLLTVTKYYIIPYLFVNFWLVLITFLQHTDPKLPHYREGAWNFQRGALCTVDRSFGKFLDHMFHGIVHTHVAHHLFSQMPFYHAEEATYHLKKLLGEYYVYDPSPIVVAVWRSFRECRFVEDHGDVVFFKK

SEQ ID NO: 27 - DNA, 1434 bp, Fusarium monoliforme
  misc_feature: delta-12 desaturase
atggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgaggagacccccgctttcactcttctcatgctcgtccttcagcagctcgttggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaa

SEQ ID NO: 28 - protein, 477 aa, Fusarium monoliforme
MASTSALPKQNPALRRTVTSTTVTDSESAAVSPSDSPRHSASSTSLSSMSEVDIAKPKSEYGVMLDTYGNQFEVPDFTIKDIYNAIPKHCFKRSALKGYGYILRDIVLLTTTFSIWYNFVTPEYIPSTPARAGLWAVYTVLQGLFGTGLWVIAHECGHGAFSDSRIINDITGWVLHSSLLVPYFSWQISHRKHHKATGNMERDMVFVPRTREQQATRLGKMTHELAHLTEETPAFTLLMLVLQQLVGWPNYLITNVTGHNYHERQREGRGKGKHNGLGGGVNHFDPRSPLYENSDAKLIVLSDIGIGLMATALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPIMGKHYRADVQDGPRGFIRAMYRSARMCQWVEPSAGAEGAGKGVLFFRNRNNVGTPPAVIKPVA

SEQ ID NO: 29 - DNA, 1416 bp, Aspergillus nidulans
  misc_feature: delta-12 desaturase
atgtcgtctactgccctcccgaagcgcgttgcgctgcatcgcaacccgactaccgactcttcggtccccagctccgtctcggtctccccgctggactcgccccgtcagtctccgtcgtcgacttcgctctcgtcaatggcctcggatgcgggcaagggagacttgggcaagatgctcgacacctatggcaatgagttcaagatccccgactacaccatcaaggatatccgtgatgccattccgtcccactgctacaaccggtctgctatcaggagtctgtcctatgtcttccgtgatctcgccgtcctcgcttccgtcttctacgtcttccacaaatacgtgaccccggagaccgtcccttcgtacccggcgcgtgttgcgctgtggactctctacactgtcgtccagggtctgttcggtaccggtatttgggttcttgctcacgagtgtggacaccaggcgttctctacttccaaggtgctcaacgacactgttggctggatcctgcattcggctctgctggtcccctatttctcgtggaagatctctcacggcaagcaccacaaggccaccggtaacctggctcgtgacatggtcttcgtccccaagacccgcgaggtgtacgcctcccgcatcaagaagaccatctacgacctgaacgaggtgatggaggagacccccttggccactgccacccactccatcctgcagcagctgttcggctggcccttgtacctgctcaccaacgttaccggtcacgacaaccacgagcgccagcctgaaggccgcggcaagggcaagcgtaacggctacttcaccggcgtcaaccacttcaaccccaacagccctctgttcgaggccaaggacgccaagctcatcattctgagtgatatcggcctcgccatcaccgccagcatcctgtacctgatcggctccaagttcggctggatgaacttgctcgtctggtacggtatcccctacctctgggtgaaccactggcttgttgccatcacctacctccagcacaccgaccccactctcccccactaccagcccgagtcctggaccttcgcccgcggtgccgctgccaccattgaccgcgagttcggcttcatcggccgtcacattctccacggcatcatcgagacccacgtcctccaccactacgtcagcaccatccccttctaccacgccgacgaggccagcgaggctatcaagaaggtcatgggctcgcactaccgcagcgaggcacacaccggtcctctgggcttcctcaaggctctctggaccagcgcccgtgtctgccactgggtcgagcccaccgaaggcaccaagggcgagaacgctggtgtcttgttcttccgcaacaccaacggcatcggtgttcctcccattaagctgaccaagcctaactaa

SEQ ID NO: 30 - protein, 471 aa, Aspergillus nidulans
MSSTALPKRVALHRNPTTDSSVPSSVSVSPLDSPRQSPSSTSLSSMASDAGKGDLGKMLDTYGNEFKIPDYTIKDIRDAIPSHCYNRSAIRSLSYVFRDLAVLASVFYVFHKYVTPETVPSYPARVALWTLYTVVQGLFGTGIWVLAHECGHQAFSTSKVLNDTVGWILHSALLVPYFSWKISHGKHHKATGNLARDMVFVPKTREVYASRIKKTIYDLNEVMEETPLATATHSILQQLFGWPLYLLTNVTGHDNHERQPEGRGKGKRNGYFTGVNHFNPNSPLFEAKDAKLIILSDIGLAITASILYLIGSKFGWMNLLVWYGIPYLWVNHWLVAITYLQHTDPTLPHYQPESWTFARGAAATIDREFGFIGRHILHGIIETHVLHHYVSTIPFYHADEASEAIKKVMGSHYRSEAHTGPLGFLKALWTSARVCHWVEPTEGTKGENAGVLFFRNTNGIGVPPIKLTKPN

SEQ ID NO: 31 - protein, 466 aa, Aspergillus flavus
  misc_feature: delta-12 desaturase
MSSTAIPKRMALNRNPGTDSSVPSVSVSPFDSPRHSPSSTSLSSLASESENKGKMLDTYGNEFKIPDYTIKQIRDAIPAHCYERKALTSLYYVFRDIAMLGSIFYVFHNYVTPETVPSFPARVALWSLYTVVQGLIATGVWVLAHECGHQAFSPSKVLNDTVGWICHSALLVPYFSWKISHGKHHKATGNIARDMVFVPKTREEYASRIGKTIHDLNELMEETPIATVTNLILQQLFGWPMYLLTNVTGHNNHERQPEGRGKGKRNGYFGGVNHFNPSSPLYEAKDAKLIVLSDLGLAITGSVLYYIGSTYGWLNLLVWYGIPYLWVNHWLVAITYLQHTDPTLPHYQPEVWNFARGAAATIDRDFGFVGRHILHGIIETHVLHHYVSTIPFYHADEASEAIQKVMGSHYRTEAHTGWTGFFKALFTSARVCHWVEPTEGARGESEGVLFYRNTNGIGVPPAKLSK

SEQ ID NO: 32 - protein, 424 aa, Aspergillus fumigatus
  misc_feature: delta-12 desaturase
MASDAEKTSSKMIDTYGNEFKIPDYTIKQIRDAIPAHCYQRSAATSLYYVFRDMAILASVFYVFHNYVTPETVPSMPVRVVLWTIYTVVQGLVGTGVWVLAHECGHQAFSTSKVLNDTVGWICHSLLLVPYFSWKISHGKHHKATGNIARDMVFVPKTREEYATRIGRAAHELSELMEETPILTATNLVLQQLFGWPMYLLTNVTGHNNHERQPEGRGKGKRNGYFGGVNHFNPSSPLYEAKDAKLIVLSDLGLFLVGSLLYYIGSTYGWLNLLVWYGIPYLWVNHWLVAITFLQHTDPTLPHYQPEAWDFTRGAAATIDRDFGFVGRHIFHGIIETHVLHHYVSTIPFYHADEASEAIQKVMGPHYRSEAHTGWTGFLKALWTSARTCQWVEPTEGAKGESQYVLFYRNINGIGVPPAKIPAK

SEQ ID NO: 33 - DNA, 1656 bp, Magnaporthe grisea
  misc_feature: delta-12 desaturase
atgccttccaccagatcgaccacatcgggcattgcccaggagaagactcctatgaggcgaacgaccacctcggccactgtcgaatcggacgtctcagctccgggaaccgctgttcagtcgcctatggactcgccccgccactctgcctcgtccacctcactctcttcactctcttccgttgatgcggcggccgagaagaaatccaacgagtctgtcggcaaactcgtcgacacgtacggcaacacctttgagatccctgacttcaccatcaaggacatccacgatgccattccaaagcactgctttgaacgctctgctattcgtagcttgagctacgtcgcccgtgatatggtcctcctggcgacgaccttctacgtgttccacaactacgtgacaccagagtacattccctcgaagccggctcgtgctggtctgtgggccatttacacggtgctccagggcctcttcggcaccggaatctgggttcttgcccatgagtgtggccaccaggctttctcgccttccaagaccatcaacaacacggttggctggattctccactcgtctctgctggttccgtacttcagctggcagatgtcacacagcaagcaccacaaggccactggccatattgagcgcgacatggtctttgtgccccgcacccgggaggagcacgccagcaggatcggccgcatggtccacgagctgtcggagttgaccgaggagacgcctattgccacccttatccacttggttgggcagcagctgatcggctggcctctgtacatcatcactaacaagaccggtcacaactaccacgagcgccagcgtgagggccgtggcaagggcaagaagaacggtcttttcactggcgtcaaccacttcaaccccagcagccctctgtacgagaacaaggacgccggaaaggtgcttctcagcgacctgggtgtcggccttgttatcgctggcctcgtgtacctttgccaaactttcggcacccagaacatgctggtttggtactttatcccctacctctgggtgaaccactggctcgttgccattacattccttcagcacaccgacccctcgcttccgcactatactgccgaggaatggaacttcgtccgaggtgccgctgccacgatcgatcgcgagtttggcttcgtcggccgccacctgcttcacggtatcattgagacccacgtcctgcaccactatgtcagcacgatccccttttacaacgccgacgaggctactgatgccatcaagaaggtgatgggcaagcactaccgcagcgacactgccggcggccctgctggcttccttaagtcactctggacgagtagccgcatgtgccaatgggttgagcccagcgccgaggctgagggtagtggcaagggtgtcctgttcttccgcaaccacaacaagatcggcactcctcctatcaagatgtctgctcagaaaattagactatgcaatgaccttcttggcatgcataagggaaagaatcaaatgaatggatcaagggagcgccgcggcggacaaagtagtttaaagagggtgagaaatcagcgatcgacaaatatgaacgaatcacacatgacggtgttccgggcattccgaacttggagctcatgcacgcgcgcgtccacatga

SEQ ID NO: 34 - protein, 551 aa, Magnaporthe grisea
MPSTRSTTSGIAQEKTPMRRTTTSATVESDVSAPGTAVQSPMDSPRHSASSTSLSSLSSVDAAAEKKSNESVGKLVDTYGNTFEIPDFTIKDIHDAIPKHCFERSAIRSLSYVARDMVLLATTFYVFHNYVTPEYIPSKPARAGLWAIYTVLQGLFGTGIWVLAHECGHQAFSPSKTINNTVGWILHSSLLVPYFSWQMSHSKHHKATGHIERDMVFVPRTREEHASRIGRMVHELSELTEETPIATLIHLVGQQLIGWPLYIITNKTGHNYHERQREGRGKGKKNGLFTGVNHFNPSSPLYENKDAGKVLLSDLGVGLVIAGLVYLCQTFGTQNMLVWYFIPYLWVNHWLVAITFLQHTDPSLPHYTAEEWNFVRGAAATIDREFGFVGRHLLHGIIETHVLHHYVSTIPFYNADEATDAIKKVMGKHYRSDTAGGPAGFLKSLWTSSRMCQWVEPSAEAEGSGKGVLFFRNHNKIGTPPIKMSAQKIRLCNDLLGMHKGKNQMNGSRERRGGQSSLKRVRNQRSTNMNESHMTVFRAFRTWSSCTRAST

SEQ ID NO: 35 - DNA, 1446 bp, Neurospora crassa
  misc_feature: delta-12 desaturase
atggcgtccgtctcctctgcccttcccgagggcaacaagcctgccctgcgcaggacccaaaccgaggccacctccgactcataccctggtaccgctgatgcctctcccttcgactctccccttgagcgctcggcctccaacacctcgctttcttcccaggcctctgacaacgtcaagaccgacaaggccgagttcggcaagctgctcgacacgtatggcaacgagttcgaggtccccgacttcaccatcaaggacatccgcgatgccatccccgcccactgctttgagcgttcggctcttcacagcttggcgcacgtcgtccgcgacatcatttacctcaccgtcactttttacgtctggaacaagtatgtcactcccgagtacatccccatgaaggctgcccgtgtcgtcctctggggtctgtacaccttcatgcagggccttttcggcaccggtctctgggttcttgcccatgagtgcggtcaccaggctttctccccgtccaggttgatcaacgacaccgtcggctgggtcctccactctgcccttctcgtcccctacttctcgtggaagttctcccacagcaagcaccacaaggccaccggcaacatcgagcgtgacatggtcttcgttcctcggacccgcgagcagtttgcgtctcgcatcggccgtttcgtccatgagatttccgagttgaccgaggagacccccatctacaccttgatccaccttatcggtcagcagctcatcggctggcccaactacctcatgaccaacgtcaccggccacaacttccacgagaggcagcgcgagggtcgtggcaagggcaagaagaacggctggttcactggtgtcaaccacttcaaccccagctctcccctctatgaggagcgtgaggccccctggatcatcgtctccgacatcggtatcgctatcgccgccaccgccctcatctacctcggcaacaccttcggctggtccaacatgttcgtctggtacttccttccctacctctgggtcaaccactggcttgttgccatcacctacctccagcacaccgacccctcgctcccccactacacccctgatcagtggaactttgtccgtggtgccgccgcgactattgaccgcgagttcggcttcatcggccgtcacctcctccacggcattatcgagacccacgttctccaccactacgtcagcaccattcccttttaccacgccgacgaggcctccgaggccatcaagaaggtcatgggccgtcactaccgcgctgacgtccaagatggccccatcggtttcatcaaggccatgtggaaggctgctcgttggtgccagtgggttgagcctaccgagggcgctgagggtaagggcaagggcgtcttgttctaccgcaaccagaacggtctcggtgtcaagcctgccaagctccccaaaaccaactaa

SEQ ID NO: 36 - protein, 481 aa, Neurospora crassa
MASVSSALPEGNKPALRRTQTEATSDSYPGTADASPFDSPLERSASNTSLSSQASDNVKTDKAEFGKLLDTYGNEFEVPDFTIKDIRDAIPAHCFERSALHSLAHVVRDIIYLTVTFYVWNKYVTPEYIPMKAARVVLWGLYTFMQGLFGTGLWVLAHECGHQAFSPSRLINDTVGWVLHSALLVPYFSWKFSHSKHHKATGNIERDMVFVPRTREQFASRIGRFVHEISELTEETPIYTLIHLIGQQLIGWPNYLMTNVTGHNFHERQREGRGKGKKNGWFTGVNHFNPSSPLYEEREAPWIIVSDIGIAIAATALIYLGNTFGWSNMFVWYFLPYLWVNHWLVAITYLQHTDPSLPHYTPDQWNFVRGAAATIDREFGFIGRHLLHGIIETHVLHHYVSTIPFYHADEASEAIKKVMGRHYRADVQDGPIGFIKAMWKAARWCQWVEPTEGAEGKGKGVLFYRNQNGLGVKPAKLPKTN

SEQ ID NO: 37 - DNA, 1371 bp, Fusarium graminearium
  misc_feature: delta-12 desaturase
tcaaccacggcgacggatactgagtctgctgccgtttctccttcagactctccccgccattcggcctcttccacctcgctctcgtctctttccgagattgatatcgccaagcccaaggccgaatatggtgttatgcttgacacctatggcaacaagttcgaggttcccgacttcaccatcaaggagatctacaatgccatccccaagcactgcttccagcgctccgctctcaagggatacggatacatcctccgcgacattgtccttcttgctaccacctttagcatctggtacaactatgtgacccccgagtacatccctagcactcccgcccgcgctggtctctgggctgtctacactgttctccagggtcttttcggtaccggtctctgggtcatcgctcacgagtgtggccacggtgctttctccgactctcgccttatcaacgacatcaccggctgggtcctccactcttctctcctcgtcccctacttcagctggcaaatctcccaccgaaagcaccacaaggctaccggaaacatggagcgtgacatggtctttgttccccgaactcgcgagcagcaggctactcgtctcggcaagatgacccacgagcttgctcacctcactgaggagacccccgtcttcactctgatcatgcttgttctccagcagctcgtcggctggcccaactacctcatgaccaacgttactggccacaactaccacgagcgtcagaaggagggccgtggcaagggcaagcacaacggtctcggcggcggtgtcaaccactttgatccccgcagccctctttacgagcacagcgatgctaagctcattgtcttgagtgatattggtatcggtctgatgggtaccgctctgtacttcctcgtccagaagtttggcttttacaacatggccatctggtactttgtcccttacctttgggtcaaccactggctcgtcgccattactttcctccagcacaccgaccctacccttccccactacaccaacgacgagtggaactttgtccgcggtgctgctgctaccatcgatcgtgagatgggtttcattggccgacacctcctccacggtatcatcgagactcacgtcctccaccactacgtcagcagcatccccttctacaacgccgacgaggctaccgaggctatcaagcctgtcatgggcaagcactaccgtgccgacgtccaggatggtccccgtggtttcattcgtgccatgtaccgcagtgcccgtatgtgccagtgggttgagcccagcgctgaggccgagggtgctggcaagggtgttctgttcttccgcaaccgcaacaaggttggcactgctcctgccgtcctcaaggcttag

SEQ ID NO: 38 - protein, 456 aa, Fusarium graminearium
STTATDTESAAVSPSDSPRHSASSTSLSSLSEIDIAKPKAEYGVMLDTYGNKFEVPDFTIKEIYNAIPKHCFQRSALKGYGYILRDIVLLATTFSIWYNYVTPEYIPSTPARAGLWAVYTVLQGLFGTGLWVIAHECGHGAFSDSRLINDITGWVLHSSLLVPYFSWQISHRKHHKATGNMERDMVFVPRTREQQATRLGKMTHELAHLTEETPVFTLIMLVLQQLVGWPNYLMTNVTGHNYHERQKEGRGKGKHNGLGGGVNHFDPRSPLYEHSDAKLIVLSDIGIGLMGTALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPVMGKHYRADVQDGPRGFIRAMYRSARMCQWVEPSAEAEGAGKGVLFFRNRNKVGTAPAVLKA

SEQ ID NO: 39 - DNA, 1209 bp, Fusarium monoliforme
  misc_feature: delta-15 desaturase
atggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactag

SEQ ID NO: 40 - protein, 402 aa, Fusarium monoliforme
MATRQRTATTVVVEDLPKVTLEAKSEPVFPDIKTIKDAIPAHCFQPSLVTSFYYVFRDFAMVSALVWAALTYIPSIPDQTLRVAAWMVYGFVQGLFCTGVWILGHECGHGAFSLHGKVNNVTGWFLHSFLLVPYFSWKYSHHRHHRFTGHMDLDMAFVPKTEPKPSKSLMIAGIDVAELVEDTPAAQMVKLIFHQLFGWQAYLFFNASSGKGSKQWEPKTGLSKWFRVSHFEPTSAVFRPNEAIFILISDIGLALMGTALYFASKQVGVSTILFLYLVPYLWVHHWLVAITYLHHHHTELPHYTAEGWTYVKGALATVDREFGFIGKHLFHGIIEKHVVHHLFPKIPFYKADEATEAIKPVIGDHYCHDDRSFLGQLWTIFGTLKYVEHDPARPGAMRWNKD

SEQ ID NO: 41 - DNA, 1206 bp, Aspergillus nidulans
  misc_feature: delta-15 desaturase
atggctgcaactgcaacaaccctagcagagattgaaaagaaaaaagaagaaataactctgcagacaatcaaaaatgcgattcccaaacactgcttcaaccgctctctcctcatttcctctgcctacgtcgtccgcgatctcctctacgcctccgtcctcttctactttgccctgcacattgacaccctcttttcctcgcaactcctccgcatcctcgcctggaccgcctacggtttcatgcaaggctgcgtcggcaccggaatctggatcctcgcacacgaatgcggccatggagctttctccccataccaaacgtggaacgatgtcgtcggatggacattgcactccctcctgatggtcccgtatttcagctggaagatcacgcacgctcgacaccaccggtacacaaacaacacagagcgagatacagcatttgtcccctggacagagaaggaatacgacactcgcccgcgctacttccctgcctggtttgagatgtttgaggacacgcccgtctacaaccttattagcctactggcgcatcagatcgcaggatggcagatgtatctctgtttttacgttagcgccggcgcaaagagtaagcctgtaccgcagggaaaacagagcgggtggtttggaggccagcagagcgccagccactttgatccgggcagttcgctgtggacggaaaaccagcggcatctgattgcgatttcggacctggggttgctgcttgttgcggcggcaaattggtaccttgcgcagcaagtgggcgtgctccgcatggtgctgatctatgttgtgccgtacttctgggtgcaccattggcttgtggcgatcacgtacctccaccacacacacccctcgatcccgcactacactgatagcacctggacgttcaccaaaggcgctctgtccaccgtcgaccgcgacttcggtttcatcgggcggcatttcttccaccatatcattgaccaccatgtcgtgcatcacttgtttaaccggatcccgttctaccatgccgaggaggcgactaatgccattattcccgtactcggggacatgtatcatcgcgaagagaccggcttcttgtggagtttaatggagacgtacaagaactgtcggtttgtaggcgttgaaaatgatgttggaaaggagggcgttttgcattgggtttttgaggagaagaagggtgccaaagcggaa

SEQ ID NO: 42 - protein, 401 aa, Aspergillus nidulans
MAATATTLAEIEKKKEEITLQTIKNAIPKHCFNRSLLISSAYVVRDLLYASVLFYFALHIDTLFSSQLLRILAWTAYGFMQGCVGTGIWILAHECGHGAFSPYQTWNDVVGWTLHSLLMVPYFSWKITHARHHRYTNNTERDTAFVPWTEKEYDTRPRYFPAWFEMFEDTPVYNLISLLAHQIAGWQMYLCFYVSAGAKSKPVPQGKQSGWFGGQQSASHFDPGSSLWTENQRHLIAISDLGLLLVAAANWYLAQQVGVLRMVLIYVVPYFWVHHWLVAITYLHHTHPSIPHYTDSTWTFTKGALSTVDRDFGFIGRHFFHHIIDHHVVHHLFNRIPFYHAEEATNAIIPVLGDMYHREETGFLWSLMETYKNCRFVGVENDVGKEGVLHWVFEEKKGAKA

SEQ ID NO: 43 - DNA, 1185 bp, Magnaporthe grisea
  misc_feature: delta-15 desaturase
atgtccaccaccgtcactcagcggccgggcgccgctagccgcgctgaagccaagcccaaggagcagcaatttccagacatcaacaccatcaggaatgctatccccgcacactgttttgaggcatctctggtgacttcagttggttacttggtgcgagatgtggccctcatcaccgctctcggctgggccgccttgacctacattccccaaattccggattcgactttgcgctggaccgcctgggccgcttacggctttgttcagggtctctttggcaccggtctctggattctggcccacgagtgcggccacggtgctttcagcaagcacacgcgcattaacaacattcttggctgggccgcccactcggccctgctggtaccgtacttcagctggaagttctctcaccaccgccaccacaacttcaccggccacatggagaaggacatggcctttgtgcccccccaggctgccgaccgcgagtcccgcgccagcttgctgtcccgcttcggcatcgacctcgaggtctttgaggatacccccatctttcagcttgctcgcctcgtgagccaccagctcttcggctggcagacttacctgctcttcaacgccacctgcggcaaggagtctctgcagaacaagggtgccgcgtggttccgccagagccactttgagcccacctctgccgtcttccgctccagcgaggccctctacatcgccatctctgacattggcctggccatcgttgccgccgccatctactggggctccaccaaggtcggcgccggcaccatgttcctcctctacgccgttccctacatgtgggttcaccactggctcgtcgccatcacctaccttcaccacaccaacaaggaggtgcaccactacgaggccgacagctggacctttgtcaagggtgccgtcgccactgtcgaccgtgactttggtttcattgaccgccacctgttccacggtatcattggaacccacgtcgcccaccatctgttccctcgcattcccttttacaaggcagaggaggccaccgaggccatcaagcctgtcctcggagacctttaccacagcgacaatcgccccttcatgcaggctctgtggagcaacttcaccacctgcaagtacgtcgagaaggaccccaaggttcccggcgccatgaggtgggccgattga

SEQ ID NO: 44 - protein, 394 aa, Magnaporthe grisea
MSTTVTQRPGAASRAEAKPKEQQFPDINTIRNAIPAHCFEASLVTSVGYLVRDVALITALGWAALTYIPQIPDSTLRWTAWAAYGFVQGLFGTGLWILAHECGHGAFSKHTRINNILGWAAHSALLVPYFSWKFSHHRHHNFTGHMEKDMAFVPPQAADRESRASLLSRFGIDLEVFEDTPIFQLARLVSHQLFGWQTYLLFNATCGKESLQNKGAAWFRQSHFEPTSAVFRSSEALYIAISDIGLAIVAAAIYWGSTKVGAGTMFLLYAVPYMWVHHWLVAITYLHHTNKEVHHYEADSWTFVKGAVATVDRDFGFIDRHLFHGIIGTHVAHHLFPRIPFYKAEEATEAIKPVLGDLYHSDNRPFMQALWSNFTTCKYVEKDPKVPGAMRWAD

SEQ ID NO: 45 - DNA, 1290 bp, Neurospora crassa
  misc_feature: delta-15 desaturase
atgacggtcaccacccgcagccacaaggccgcggccgccaccgagcccgaggttgtcagcaccggcgttgacgccgtctctgctgctgctccctcctcctcctcctcctcttccagccaaaagtcggccgagcccatcgaataccccgacatcaagaccatccgcgacgccatccccgaccactgcttccgcccgcgcgtctggatctccatggcctacttcatccgcgacttcgccatggcctttggcctcggctacctcgcctggcagtacatccccctgatcgcctccaccccgctccgctacggcgcctgggctctgtacggctacctccagggtctcgtctgcacgggcatctggattctggcgcacgagtgcggccacggcgccttctcgaggcacacgtggttcaacaacgtcatggggtggattggccactccttcctcttggtcccttacttcagctggaagttcagccaccatcgccaccatcgcttcaccggccacatggagaaggacatggcgtttgtgcctgccaccgaggctgatcgcaaccagaggaagctggccaacttgtacatggacaaggagacggccgagatgtttgaggatgtgcccattgtccagctcgtcaagctcatcgcccaccagctggccggctggcagatgtacctcctcttcaacgtctccgccggtaagggcagcaagcagtgggagactggcaagggcggcatgggctggttgagggttagccactttgagccttcctctgctgtgttccgcaactccgaggccatctacattgccctgtccgatcttggtctcatgatcatgggctatatcctctaccaggccgcgcaggttgttggctggcagatggtaggtctgctgtacttccagcagtacttctgggttcaccattggttggtcgccatcacttacctccaccacacccacgaggaagtccaccactttgacgccgactcgtggaccttcgtcaagggcgctctcgccaccgtcgaccgcgattttggcttcattggcaagcacctcttccacaacattatcgaccaccacgtcgtccaccacttgttccctcgcatccccttctactacgccgaagaagccaccaactcgatccgccccatgctcggccccctctaccaccgcgacgaccgctccttcatgggccagctgtggtacaacttcacccactgcaagtgggtcgttccggacccccaggtccccggcgcgcttatttgggcgcacaccgttcagagcacccagtaa

SEQ ID NO: 46 - protein, 429 aa, Neurospora crassa
MTVTTRSHKAAAATEPEVVSTGVDAVSAAAPSSSSSSSSQKSAEPIEYPDIKTIRDAIPDHCFRPRVWISMAYFIRDFAMAFGLGYLAWQYIPLIASTPLRYGAWALYGYLQGLVCTGIWILAHECGHGAFSRHTWFNNVMGWIGHSFLLVPYFSWKFSHHRHHRFTGHMEKDMAFVPATEADRNQRKLANLYMDKETAEMFEDVPIVQLVKLIAHQLAGWQMYLLFNVSAGKGSKQWETGKGGMGWLRVSHFEPSSAVFRNSEAIYIALSDLGLMIMGYILYQAAQVVGWQMVGLLYFQQYFWVHHWLVAITYLHHTHEEVHHFDADSWTFVKGALATVDRDFGFIGKHLFHNIIDHHVVHHLFPRIPFYYAEEATNSIRPMLGPLYHRDDRSFMGQLWYNFTHCKWVVPDPQVPGALIWAHTVQSTQ

SEQ ID NO: 47 - DNA, 1212 bp, Fusarium graminearium
  misc_feature: delta-15 desaturase
atggccaccagacagcgaactgccaccactgttgtggtcgagaaggacctgcccaaggtcactctcgaggccacttctcagcctcaattccccgacatcaagaccatcaaggatgccatccccgcccactgcttccagccctcgctcatcacctcatactactatgtcgtccgcgacttcgccatggtcggctccctcgtctgggccgccctcacctacatccccggcattgaggaccagtacctccgcgtcgccgcctggatggcctacggcttcctccagggtctcttctgcaccggaatctggattctcggtcatgagtgcggccacggtgccttctctacccacagcaagctcaacaatgtgaccggctggttcctccactcgttcctcatggtcccctatttcagctggaagtactctcaccaccgtcaccaccgcttcaccggccacatggatctcgacatggcctttgtcccccgcacttcgcccaagccttctttgtctttccgcattgctggtatggacgtcgctgagctgattgaggacacccccattgcccaggccgtcaagctcatcttccaccagctcttcggatggcaggtgtacaccttcttcaacgccagctctggcaagggtagcaagcagtgggagcccaagagcggcttggccagctggttccgcgtcagccacttcgagcccaccagcgctgtcttccgccccgccgaggctcctttcatcctcatctccgacattggtctcgccctcactggaactgctctgtactttgcttccaaggaggtcggcgtttccaccgttctctacctctacctcgtcccctacctctgggtccaccactggctcgtcgccatcacctacctccaccaccaccacaccgagcttccccactacaccgccgagggctggacctacgtcaagggtgctctcgctactgttgaccgcgagtttggcttcattggcaagcaccttttccacggcatcattgagaagcacgtcattcaccacctgttccctaagatccccttctacaaggctgacgaggccaccgaggccatcaagcccatcatcggcgaccactactgccacgacgaccgcagcttccttggccagctctggaccatctttggcagcctcaagtacgtcgagcacgaccccgccgtccctggtgccatgcgctgggccaaggagtag

SEQ ID NO: 48 - protein, 403 aa, Fusarium graminearium
MATRQRTATTVVVEKDLPKVTLEATSQPQFPDIKTIKDAIPAHCFQPSLITSYYYVVRDFAMVGSLVWAALTYIPGIEDQYLRVAAWMAYGFLQGLFCTGIWILGHECGHGAFSTHSKLNNVTGWFLHSFLMVPYFSWKYSHHRHHRFTGHMDLDMAFVPRTSPKPSLSFRIAGMDVAELIEDTPIAQAVKLIFHQLFGWQVYTFFNASSGKGSKQWEPKSGLASWFRVSHFEPTSAVFRPAEAPFILISDIGLALTGTALYFASKEVGVSTVLYLYLVPYLWVHHWLVAITYLHHHHTELPHYTAEGWTYVKGALATVDREFGFIGKHLFHGIIEKHVIHHLFPKIPFYKADEATEAIKPIIGDHYCHDDRSFLGQLWTIFGSLKYVEHDPAVPGAMRWAKE

SEQ ID NO: 49 - DNA, 792 bp, Isochrysis galbana
  misc_feature: delta-9 elongase
atggccctcgcaaacgacgcgggagagcgcatctgggcggctgtgaccgacccggaaatcctcattggcaccttctcgtacttgctactcaaaccgctgctccgcaattccgggctggtggatgagaagaagggcgcatacaggacgtccatgatctggtacaacgttctgctggcgctcttctctgcgctgagcttctacgtgacggcgaccgccctcggctgggactatggtacgggcgcgtggctgcgcaggcaaaccggcgacacaccgcagccgctcttccagtgcccgtccccggtttgggactcgaagctcttcacatggaccgccaaggcattctattactccaagtacgtggagtacctcgacacggcctggctggtgctcaagggcaagagggtctcctttctccaggccttccaccactttggcgcgccgtgggatgtgtacctcggcattcggctgcacaacgagggcgtatggatcttcatgtttttcaactcgttcattcacaccatcatgtacacctactacggcctcaccgccgccgggtataagttcaaggccaagccgctcatcaccgcgatgcagatctgccagttcgtgggcggcttcctgttggtctgggactacatcaacgtcccctgcttcaactcggacaaagggaagttgttcagctgggctttcaactatgcatacgtcggctcggtcttcttgctcttctgccactttttctaccaggacaacttggcaacgaagaaatcggccaaggcgggcaagcagctctag

SEQ ID NO: 50 - protein, 263 aa, Isochrysis galbana
MALANDAGERIWAAVTDPEILIGTFSYLLLKPLLRNSGLVDEKKGAYRTSMIWYNVLLALFSALSFYVTATALGWDYGTGAWLRRQTGDTPQPLFQCPSPVWDSKLFTWTAKAFYYSKYVEYLDTAWLVLKGKRVSFLQAFHHFGAPWDVYLGIRLHNEGVWIFMFFNSFIHTIMYTYYGLTAAGYKFKAKPLITAMQICQFVGGFLLVWDYINVPCFNSDKGKLFSWAFNYAYVGSVFLLFCHFFYQDNLATKKSAKAGKQL

SEQ ID NO: 51 - DNA, 792 bp, Artificial Sequence
  IgD9e: synthetic delta-9 elongase (codon-optimized for Yarrowia lipolytica)
atggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttag

SEQ ID NO: 52 - DNA, 1275 bp, Euglena gracilis (GenBank Accession Nos. AF139720 and AAD45877)
  misc_feature (14)..(1273): non-functional delta-8 desaturase
attttttttcgaaatgaagtcaaagcgccaagcgctatcccccttacaattgatggaacaaacatatgatgtggtcaatttccaccctggtggtgcggaaattatagagaattaccaaggaagggatgccactgatgccttcatggttatgcactttcaagaagccttcgacaagctcaagcgcatgcccaaaatcaatcccagttttgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatgttggaaggacagacacaatgcacatcattcggcaaccaatgttcaagggcacgaccctgatattgacaacctcccccccttagcctggtctgaggatgacgtcacacgggcgtcaccgatttcccgcaagctcattcagttccagcagtactatttcttggtcatctgtatcttgttgcggttcatttggtgtttccagtgcgtgttgaccgtgcgcagtttgaaggacagagataaccaattctatcgctctcagtataagaaggaggccattggcctcgccctgcactggaccttgaaggccctgttccacttattctttatgcccagcatcctcacatcgctgttggtgtttttcgtttcggagctggttggcggcttcggcattgcgatcgtggtgttcatgaaccactacccactggagaagatcggggacccagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 53 - protein, 419 aa, Euglena gracilis (GenBank Accession No. AF139720 and AAD45877)
MKSKRQALSPLQLMEQTYDVVNFHPGGAEIIENYQGRDATDAFMVMHFQEAFDKLKRMPKINPSFELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTCWKDRHNAHHSATNVQGHDPDIDNLPPLAWSEDDVTRASPISRKLIQFQQYYFLVICILLRFIWCFQCVLTVRSLKDRDNQFYRSQYKKEAIGLALHWTLKALFHLFFMPSILTSLLVFFVSELVGGFGIAIVVFMNHYPLEKIGDPVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 54 - protein, 422 aa, Euglena gracilis
MKSKRQALSPLQLMEQTYDVSAWVNFHPGGAEIIENYQGRDATDAFMVMHFQEAFDKLKRMPKINPSFELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTCWKDRHNAHHSATNVQGHDPDIDNLPPLAWSEDDVTRASPISRKLIQFQQYYFLVICILLRFIWCFQCVLTVRSLKDRDNQFYRSQYKKEAIGLALHWTLKALFHLFFMPSILTSLLVFFVSELVGGFGIAIVVFMNHYPLEKIGDPVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 55 - DNA, 1270 bp, Artificial Sequence
  D8S-1: Synthetic gene codon-optimized for expression in Yarrowia lipolytica
ccatggagtccaagcgacaggctctgtctcccctccagctgatggaacagacctacgacgtcgtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcactcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagctcgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagcggccgc

SEQ ID NO: 56 - DNA, 1269 bp, Artificial Sequence
  D8S-3:  synthetic delta 8-desaturase gene codon-optimized for Yarrowia lipolytica in pDMW261
atgaagtccaagcgacaggctctgtctcccctccagctgatggaacagacctacgacgtctccgcttgggtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcactcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagctcgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaa

SEQ ID NO: 57 - DNA, 1271 bp, Euglena gracilis
  misc_feature (4)..(1269): Eg5: delta-8 desaturase
gaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 58 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 59 - DNA, 1271 bp, Euglena gracilis
  misc_feature (4)..(1269): Eg12: delta-8 desaturase
gaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaaggccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 60 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKALFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 61 - DNA, 1272 bp, Artificial Sequence
  D8SF: synthetic delta-8 desaturase (codon-optimized for Yarrowia lipolytica)
catggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 62 - protein, 422 aa, Artificial Sequence
  D8SF: synthetic delta-8 desaturase (codon-optimized for Yarrowia lipolytica)
MVKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 63 - DNA, 2628 bp, Rattus norvegicus (GenBank Accession No. AB071986)
  CDS (90)..(893): C16/18 elongase
tggatgcggacgctgggaggagagcccctgagctaggagctgggagccgaggcgcagagaacacgtagcgactccgaagatcagccccaatgaacatgtcagtgttgactttacaagaatatgaattcgagaagcagttcaacgagaatgaagccatccaatggatgcaggaaaactggaagaaatctttcctgttttctgcgctgtacgctgcctttatatttggtggtcggcatctgatgaacaagcgggccaagtttgaactgcggaagccgctcgtgctctggtcactgactcttgcggtcttcagtatattcggtgctcttcgaactggtgcttacatgctgtacattttgatgaccaaaggcctgaagcagtcagtttgtgaccagagtttttacaacggacctgtcagcaaattctgggcttacgcgtttgtgctcagcaaagcacccgaactaggtgatacgatattcatcattctgaggaagcagaagctgatcttcctgcactggtaccaccacatcactgtgctcctgtactcttggtactcctacaaagacatggtagctgggggtggttggttcatgactatgaactatggcgtacacgccgtcatgtactcttactacgccttgcgggctgcgggtttccgggtctcccggaagtttgccatgttcatcacgttgtcccagatcactcagatgctgatgggctgtgtcattaactacctggtcttcaactggatgcagcatgacaatgaccagtgctactcccactttcagaacatcttctggtcctcactcatgtacctcagctaccttctgctcttctgccatttcttctttgaggcctacatcggcaaagtgaagaaagcgacgaaggccgagtagtgtcagagctgaggaggaagacatagctcagggtcatcacgaaaaataatagacaaaaagaaaatggcacaaggaatcacatatggtgcagctaaaacaaaacaaaacattatgagcagacgctaagcccaaggcagcttgggagtgaagattaggttgtaagtttatgatcctttttgggtgaggactcactgagaacactgctgctgagggacccccttccctcttacctgtcaactctagaacacactagaagccaaggcagccatgggcaaggagattagtggacagcaagcaaaacactgcaggaagaggggggagatctattcagagttttttgttttgttttgttttgtttttctctaaggataaaggagtttccccttttcaaactgtgtgagcacacccacgcgcatgcggacacacacacacacacacatacacacacacacacacatacacacatacacacacacacacacacacacacacacaatcttttccacaggaaaccagagctggtagaaaagataaacggtaagcgacagggtttctatctaggacagcaatgcttttgcaaaaacctaagccttttaaagaagttagcttgtaactccttgacaaaagatgtcttaattctttttactgtaactgaaagtcaaaaaggtagataccttccccttcactgcacagcctcgggcttgttcgtttgctacaacggagcagaggacagttcttccgtgatactttatttctgggagaaagaaaaccatgcagcccaaatcccgagaaggcggcccatagctaaccctgcagttgaagcatcacactgacagctgttatttctgctcttcggtgagaattgaagcagccgttgttcaattaccccaaactttaggatgggggagtaaatacggaattgaaaagaaagaagctcgactggttggcttgaaaatggaatcttgtactatctataacaaaactcagcccatcgtccctggagctggaaggactatcagaagagaccagaactgaagattcatccaatacacagatggcatgttcgcctccttccccgtttgacctcacacatagtcctggctttctaaatgaggtcctatgacccagtctgtgttttctatatttttgtgactttcaaaaacagatccgcagggctctgcatttggggtaaacactgtgtttctgcagcctctgcattcgctcccttcagcaatgcagaggcgtgagaagtgccctctgctggcttagtgagaagcttcaacaaacacttcataataggttgaaatagctgaccacaaagggcctgcgtagattaaaccctaagttaagttctaagtgctgtcaaacacctgacatatatttgaccaaatcagaagagagagaacctctatgcttcaagtaagcttcataaaaaatttttaaagtgactttcacttgggaactcagaaagtcaatgtattaagagccatattcttaaaaaaaaaaagaaagaaagaaaagaagaagaagaaagctagacaatgttatctgtaatatttcagtcctttacaagccaaataaatgtgtcgatgttcctaaaaaaaaaaaaaaaaacggtccgcggccgccctttagtgagggttaatttaaatcgtacgtcgcgattaattaaccgcggtaccttctgaggcggaaagaaccagccggatccctcgagggatccagacatgataaa

SEQ ID NO: 64 - protein, 267 aa, Rattus norvegicus (GenBank Accession No. AB071986)
MNMSVLTLQEYEFEKQFNENEAIQWMQENWKKSFLFSALYAAFIFGGRHLMNKRAKFELRKPLVLWSLTLAVFSIFGALRTGAYMLYILMTKGLKQSVCDQSFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVINYLVFNWMQHDNDQCYSHFQNIFWSSLMYLSYLLLFCHFFFEAYIGKVKKATKAE

SEQ ID NO: 65 - DNA, 804 bp, Rattus norvegicus
  misc_feature: synthetic C16/18 elongase (codon-optimized)
atggacatgtccgtcctgactctccaagagtacgagttcgagaagcagttcaacgagaatgaagccatccaatggatgcaggaaaactggaagaaatccttcctgttttctgccctctacgctgcctttatctttggtggacgacatctgatgaacaagcgagccaagtttgagctgcgaaaacctctcgtgctctggtccctgaccctcgctgtcttctctatcttcggtgctctgcgaactggagcctacatgctctacatcctgatgaccaaaggcctgaaacagtctgtttgtgaccagtccttttacaacggacccgtctcgaaattctgggcttacgcctttgtgctctccaaagctcccgaacttggcgataccatcttcatcattctgcgaaagcagaaactcatcttcctgcactggtatcaccacatcaccgtcctcctgtactcttggtactcctacaaggacatggtggctggaggtggctggttcatgactatgaactacggtgtccacgccgtgatgtactcctactacgccctccgagctgccggtttccgagtctctcgaaagtttgccatgttcatcaccctgtcgcagatcactcagatgctcatgggctgtgtcattaactacctggtcttcaactggatgcagcatgacaatgaccagtgctactcccactttcagaacatcttctggtcctctctcatgtacctctcctaccttctgctcttctgccatttcttctttgaggcctacattggcaaagtgaagaaagccaccaaggctgagtaa

SEQ ID NO: 66 - DNA, 828 bp, Mortierella alpina
  misc_feature: C16/18 elongase
atggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaa

SEQ ID NO: 67 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 68 - DNA, 607 bp, Mortierella alpina
  misc_feature (133)..(135): ATG translation initiation codon
cccgtcttcaccctccctcttccccccgttcctacgtctacagccgttggctcatcttgcagttgcttgtctactatttggtgccgacctatattcctctgtcacccaacctaccgcactcacactcgcataatggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgcta

SEQ ID NO: 69 - DNA, 1042 bp, Mortierella alpina
  misc_feature (402)..(404): Stop codon
tgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaaagaggccacttcttgtcgtttactctactgtttccaacatttacatctctcaatggcagcctcctccctctatccttcgcactttcattttagttccttgtattcataaaargtcaaaattcattgtaactccaaaagtgccaatggctttatcatggatgagtgccatgtttatggcccattgcatcaatacaggaagatatgagcggtcagcgatagctattcctctgagttgtcctggccttgtatgcactctcgaaggaggaaatggatcggagcatcagcactatttcaggactaggagagatacatccaaaattttaaaggcatctctggtcagtacaagagcgacttggcaacaagtctttagtcaaacttcctcacctttgaacttcctcagaggtcgccgtggcactgtggacggagacccgtgaaaagaactcatgcagcaggttaagcaaccttggaaatccatcgatgaatgcctgatgtaaaaattgagaagctgcaagagccaaaagttcagttcagcacatataagagactttggccaagagcgatgaagtcacatgggaaccacgtaaacaaacctcgtgcggagsaccagcccgggccgtcgaccacgcgtgccctatagt

SEQ ID NO: 70 - DNA, 2223 bp, Mortierella alpina
  misc_feature (2092)..(2094): ATG translation initiation codon
actatagggcacgcgtggtcgacggcccgggctggtcctacctctcaatcttgttgccctgtagtcctgaaatgagctcgtcatgggtctctgtcctctcctcgttatggtcaaacgcattggacccggttttctttagaggagcattcttcttgtttaagccgactcctcttcccgtcccgaacgacaacttgataggtccaccatttccatttggtgggtgaagcgggctgtcctcagcggacatgactctgagctagaaggaagggtgtagaggacgaaggagtaagtgctaccgttcactggcaggtgaggagcgtcgggtctaagccacatgcctgccaattgtcctcgccaagtgcttggaaggtgtattgatgctcatgcagctccactctggacctggaaacgccaccgcatcgcattcttaatgagctctgctacaaacgacaatctgcgaaccagtttgcacagggagctagtcgagtctggaaagcgggaccagtgagtgactcggcggggcttgcatcgctgaacatcgccattgggatttcttagaaagcagctcttgctcttatacaaacaccttcctgcgtgcctcaccttacttacgaggagtaatgttgtttttacaggctagtggaactcttgcgcgcgaggctgatcgagtccggctggcgggacgatctgaaggcatttacaaaaggtacaccactcggcacttggcctgttttgttgccactagctaccaggccgtgactgaccacgaacccttcctctggagaatagaaaggatccagtcccgggagactacaatgtctgttgacgaggtcatcagagaagtcggcccacatgctagaggtaagccccgcgagaaccttatatgctgattagtgccatccgttgaacatcgtctgatctgcgacaagttctggtaatacttgatagccaccgtcccagacaaggtcaagacagaacttcttgcgcaaatcagtacttttatcgaagacaacatgtaacgaaaaataaaaatgctgatatggaagggaacatcacgtacgccaggtacgtgagatgtttttccttttttttttattttttttgttggggcttgagatgttttgggtctttcatgaagacgttcatgacaaacaagaaatacggacagcgagtttaccgcaatggaaaagtttacctcaaccgaactttgaacgtttcgtgaaaacctgcgtgagaattctttgagcatggccatacctaattgtcgccggactgatctgtgatttgatccatggtccatcgctcctgactcgctgcacgtcctgacagagataacctcgcatagtgtcgtacagaaaccaaaagcacgcgctcggtccagtacagtaatggggaactgggtactgaggacagcttgaaagtatatcctgtaggggacgataacatgggcaatcttgatggtgtggttgagtacagggtatatgcgttccaggtaagcaaatatcacctttgtgagacgatagggggcagctatagtaaatggccaggcgcttttatacgggaagcaattgcagcgatggaggtgtgtacgctgcagccgcttgtatagcagaacgtaaccccaatcctccaactccggcaaggacaatggggaaagaaggccggatatataaaatgcttgtcagcagaattaaagactgtgcggactgatctgccttaatcggaaacttcagcagggcttctcgcagtgcatgaaccctcggaccatctcctgtcccaacaacacgccaatgggcttattattaattttttttggctgccgttcaaaaaaaaaaagaaaaaaactgccacttcttatttgagggctgcaggactgcttgttaaggcggataacctcaatccgcccgatgccttttaacgctggcctgttcttcctcttttctttcttctctcccttcacccgtcttcaccctccctcttccccccgttcctacgtctacagccgttggctcatcttgcagttgcttgtctactatttggtgccgacctatattcctctgtcacccaacctaccgcactcacactcgcataatggagtctggacctatgcctgccgggatccccttccctgaatactatgactttttcatggactggaagacacccctggcaattgctgccacctacaccgccgctgttgggctcttcaaccccaaggttggc

SEQ ID NO: 71 - DNA, 3557 bp, Mortierella alpina
  misc_feature (2092)..(2094): ATG translation initiation codon
  misc_feature (2917)..(2919): 'TAA' stop codon
actatagggcacgcgtggtcgacggcccgggctggtcctacctctcaatcttgttgccctgtagtcctgaaatgagctcgtcatgggtctctgtcctctcctcgttatggtcaaacgcattggacccggttttctttagaggagcattcttcttgtttaagccgactcctcttcccgtcccgaacgacaacttgataggtccaccatttccatttggtgggtgaagcgggctgtcctcagcggacatgactctgagctagaaggaagggtgtagaggacgaaggagtaagtgctaccgttcactggcaggtgaggagcgtcgggtctaagccacatgcctgccaattgtcctcgccaagtgcttggaaggtgtattgatgctcatgcagctccactctggacctggaaacgccaccgcatcgcattcttaatgagctctgctacaaacgacaatctgcgaaccagtttgcacagggagctagtcgagtctggaaagcgggaccagtgagtgactcggcggggcttgcatcgctgaacatcgccattgggatttcttagaaagcagctcttgctcttatacaaacaccttcctgcgtgcctcaccttacttacgaggagtaatgttgtttttacaggctagtggaactcttgcgcgcgaggctgatcgagtccggctggcgggacgatctgaaggcatttacaaaaggtacaccactcggcacttggcctgttttgttgccactagctaccaggccgtgactgaccacgaacccttcctctggagaatagaaaggatccagtcccgggagactacaatgtctgttgacgaggtcatcagagaagtcggcccacatgctagaggtaagccccgcgagaaccttatatgctgattagtgccatccgttgaacatcgtctgatctgcgacaagttctggtaatacttgatagccaccgtcccagacaaggtcaagacagaacttcttgcgcaaatcagtacttttatcgaagacaacatgtaacgaaaaataaaaatgctgatatggaagggaacatcacgtacgccaggtacgtgagatgtttttccttttttttttattttttttgttggggcttgagatgttttgggtctttcatgaagacgttcatgacaaacaagaaatacggacagcgagtttaccgcaatggaaaagtttacctcaaccgaactttgaacgtttcgtgaaaacctgcgtgagaattctttgagcatggccatacctaattgtcgccggactgatctgtgatttgatccatggtccatcgctcctgactcgctgcacgtcctgacagagataacctcgcatagtgtcgtacagaaaccaaaagcacgcgctcggtccagtacagtaatggggaactgggtactgaggacagcttgaaagtatatcctgtaggggacgataacatgggcaatcttgatggtgtggttgagtacagggtatatgcgttccaggtaagcaaatatcacctttgtgagacgatagggggcagctatagtaaatggccaggcgcttttatacgggaagcaattgcagcgatggaggtgtgtacgctgcagccgcttgtatagcagaacgtaaccccaatcctccaactccggcaaggacaatggggaaagaaggccggatatataaaatgcttgtcagcagaattaaagactgtgcggactgatctgccttaatcggaaacttcagcagggcttctcgcagtgcatgaaccctcggaccatctcctgtcccaacaacacgccaatgggcttattattaattttttttggctgccgttcaaaaaaaaaaagaaaaaaactgccacttcttatttgagggctgcaggactgcttgttaaggcggataacctcaatccgcccgatgccttttaacgctggcctgttcttcctcttttctttcttctctcccttcacccgtcttcaccctccctcttccccccgttcctacgtctacagccgttggctcatcttgcagttgcttgtctactatttggtgccgacctatattcctctgtcacccaacctaccgcactcacactcgcataatggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaaagaggccacttcttgtcgtttactctactgtttccaacatttacatctctcaatggcagcctcctccctctatccttcgcactttcattttagttccttgtattcataaaargtcaaaattcattgtaactccaaaagtgccaatggctttatcatggatgagtgccatgtttatggcccattgcatcaatacaggaagatatgagcggtcagcgatagctattcctctgagttgtcctggccttgtatgcactctcgaaggaggaaatggatcggagcatcagcactatttcaggactaggagagatacatccaaaattttaaaggcatctctggtcagtacaagagcgacttggcaacaagtctttagtcaaacttcctcacctttgaacttcctcagaggtcgccgtggcactgtggacggagacccgtgaaaagaactcatgcagcaggttaagcaaccttggaaatccatcgatgaatgcctgatgtaaaaattgagaagctgcaagagccaaaagttcagttcagcacatataagagactttggccaagagcgatgaagtcacatgggaaccacgtaaacaaacctcgtgcggagsaccagcccgggccgtcgaccacgcgtgccctatagt

SEQ ID NO: 72 - DNA, 542 bp, Mortierella alpina
  Intron (1)..(542)
cgtaagttgacaacggttcaaatttcgaaacttgcactgtgggtttgtcctggttttattcggcagcttttttctccgaagtcttggcccagggaggaggcaagaagagcaattcagggtaggggcgtccggagattggaccctgccttggactagcgaatggaatacgagagcgaagctgtctgcatgggctgatgataatattttttactggagatgattgtaaggtgcggcgcgagggtgtagtacatcagtcgacatggattcaaccaaatgttctctagcagcgataaccctggctgtcttttgttaatcacggcaatgctatccccaaagaaaaaaaaaagggtgcggttggcacacggttgcacaatggcttagccagacaattaacccaaaaaagtcaagagattcctttttttttttttttttttttggggggggaacgggaaagtgggggctgtgtgaaattggggcgaagtgaaccatgcaactttgagctacaaacacctaattgtttttgtcttgcctgacattattag

SEQ ID NO: 73 - DNA, 4099 bp, Mortierella alpina
  misc_feature (2092)..(2094): ATG translation initiation codon
  Intron (2410)..(2951)
  misc_feature (3459)..(3461): 'TAA' stop codon
actatagggcacgcgtggtcgacggcccgggctggtcctacctctcaatcttgttgccctgtagtcctgaaatgagctcgtcatgggtctctgtcctctcctcgttatggtcaaacgcattggacccggttttctttagaggagcattcttcttgtttaagccgactcctcttcccgtcccgaacgacaacttgataggtccaccatttccatttggtgggtgaagcgggctgtcctcagcggacatgactctgagctagaaggaagggtgtagaggacgaaggagtaagtgctaccgttcactggcaggtgaggagcgtcgggtctaagccacatgcctgccaattgtcctcgccaagtgcttggaaggtgtattgatgctcatgcagctccactctggacctggaaacgccaccgcatcgcattcttaatgagctctgctacaaacgacaatctgcgaaccagtttgcacagggagctagtcgagtctggaaagcgggaccagtgagtgactcggcggggcttgcatcgctgaacatcgccattgggatttcttagaaagcagctcttgctcttatacaaacaccttcctgcgtgcctcaccttacttacgaggagtaatgttgtttttacaggctagtggaactcttgcgcgcgaggctgatcgagtccggctggcgggacgatctgaaggcatttacaaaaggtacaccactcggcacttggcctgttttgttgccactagctaccaggccgtgactgaccacgaacccttcctctggagaatagaaaggatccagtcccgggagactacaatgtctgttgacgaggtcatcagagaagtcggcccacatgctagaggtaagccccgcgagaaccttatatgctgattagtgccatccgttgaacatcgtctgatctgcgacaagttctggtaatacttgatagccaccgtcccagacaaggtcaagacagaacttcttgcgcaaatcagtacttttatcgaagacaacatgtaacgaaaaataaaaatgctgatatggaagggaacatcacgtacgccaggtacgtgagatgtttttccttttttttttattttttttgttggggcttgagatgttttgggtctttcatgaagacgttcatgacaaacaagaaatacggacagcgagtttaccgcaatggaaaagtttacctcaaccgaactttgaacgtttcgtgaaaacctgcgtgagaattctttgagcatggccatacctaattgtcgccggactgatctgtgatttgatccatggtccatcgctcctgactcgctgcacgtcctgacagagataacctcgcatagtgtcgtacagaaaccaaaagcacgcgctcggtccagtacagtaatggggaactgggtactgaggacagcttgaaagtatatcctgtaggggacgataacatgggcaatcttgatggtgtggttgagtacagggtatatgcgttccaggtaagcaaatatcacctttgtgagacgatagggggcagctatagtaaatggccaggcgcttttatacgggaagcaattgcagcgatggaggtgtgtacgctgcagccgcttgtatagcagaacgtaaccccaatcctccaactccggcaaggacaatggggaaagaaggccggatatataaaatgcttgtcagcagaattaaagactgtgcggactgatctgccttaatcggaaacttcagcagggcttctcgcagtgcatgaaccctcggaccatctcctgtcccaacaacacgccaatgggcttattattaattttttttggctgccgttcaaaaaaaaaaagaaaaaaactgccacttcttatttgagggctgcaggactgcttgttaaggcggataacctcaatccgcccgatgccttttaacgctggcctgttcttcctcttttctttcttctctcccttcacccgtcttcaccctccctcttccccccgttcctacgtctacagccgttggctcatcttgcagttgcttgtctactatttggtgccgacctatattcctctgtcacccaacctaccgcactcacactcgcataatggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcccgtaagttgacaacggttcaaatttcgaaacttgcactgtgggtttgtcctggttttattcggcagcttttttctccgaagtcttggcccagggaggaggcaagaagagcaattcagggtaggggcgtccggagattggaccctgccttggactagcgaatggaatacgagagcgaagctgtctgcatgggctgatgataatattttttactggagatgattgtaaggtgcggcgcgagggtgtagtacatcagtcgacatggattcaaccaaatgttctctagcagcgataaccctggctgtcttttgttaatcacggcaatgctatccccaaagaaaaaaaaaagggtgcggttggcacacggttgcacaatggcttagccagacaattaacccaaaaaagtcaagagattcctttttttttttttttttttttggggggggaacgggaaagtgggggctgtgtgaaattggggcgaagtgaaccatgcaactttgagctacaaacacctaattgtttttgtcttgcctgacattattagtactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaaagaggccacttcttgtcgtttactctactgtttccaacatttacatctctcaatggcagcctcctccctctatccttcgcactttcattttagttccttgtattcataaaargtcaaaattcattgtaactccaaaagtgccaatggctttatcatggatgagtgccatgtttatggcccattgcatcaatacaggaagatatgagcggtcagcgatagctattcctctgagttgtcctggccttgtatgcactctcgaaggaggaaatggatcggagcatcagcactatttcaggactaggagagatacatccaaaattttaaaggcatctctggtcagtacaagagcgacttggcaacaagtctttagtcaaacttcctcacctttgaacttcctcagaggtcgccgtggcactgtggacggagacccgtgaaaagaactcatgcagcaggttaagcaaccttggaaatccatcgatgaatgcctgatgtaaaaattgagaagctgcaagagccaaaagttcagttcagcacatataagagactttggccaagagcgatgaagtcacatgggaaccacgtaaacaaacctcgtgcggagsaccagcccgggccgtcgaccacgcgtgccctatagt

SEQ ID NO: 74 - DNA, 915 bp, Yarrowia lipolytica
  CDS (1)..(915): C16/18 elongase
atgctctcgtcaatctcgcccgacctatactcgtccttctcgttcaaaaactcgctcgccgaggccatgccctccgtgccacacgaactcatcaactcaaaaacactctcatggatgtacaatgcctctctggacattcgggttcctctgactatcggaaccatctacgccgtctccgtgcacctgaccaactcatctgaacgaatcaagaaacgccagcccattgcctttgccaagaccgcactcttcaagtggctctgtgtcctccacaatgcaggtctgtgtctctactcagcatggacctttgtcggtatcctcaacgccgtcaaacacgcctaccaaatcacaggagacagctccgcccccttctccttcaacaccctctggggatcgttttgttcacgtgactccctctgggtcaccggcctcaactactacggatactggttctatctgtccaaattctacgaagtggtggacaccatgatcatcctcgcaaagggaaaaccgtcctcaatgctccagacataccaccacaccggcgccatgttctccatgtgggccggcatccgattcgcctctccccccatctggatctttgtggttttcaactccctcatccacacaatcatgtacttttactacaccctcaccaccctcaagatcaaggttcccaagatcctcaaggcatctctgaccaccgcccagatcacccagattgtcggaggtggcatcctggctgcctcccacgcctttatttattacaaggaccaccagactgagaccgtctgttcttgtctcactacccagggtcagtttttcgctctcgccgtcaatgtcatctatctgagtcctctggcctatctctttattgccttctggattcgatcttacttgaaggccaagtccaactag

SEQ ID NO: 75 - protein, 304 aa, Yarrowia lipolytica
MLSSISPDLYSSFSFKNSLAEAMPSVPHELINSKTLSWMYNASLDIRVPLTIGTIYAVSVHLTNSSERIKKRQPIAFAKTALFKWLCVLHNAGLCLYSAWTFVGILNAVKHAYQITGDSSAPFSFNTLWGSFCSRDSLWVTGLNYYGYWFYLSKFYEVVDTMIILAKGKPSSMLQTYHHTGAMFSMWAGIRFASPPIWIFVVFNSLIHTIMYFYYTLTTLKIKVPKILKASLTTAQITQIVGGGILAASHAFIYYKDHQTETVCSCLTTQGQFFALAVNVIYLSPLAYLFIAFWIRSYLKAKSN

SEQ ID NO: 76 - protein, 353 aa, Candida albicans (GenBank Accession No. EAL04510)
MLAKFKLPNAEVWKTFPPFDTPVPPSPFENEFLNKIYYASMNVTTPLTIAIIYFTSVHFINSIIRNKQIAKYNSKTSSESKVDITKLDDKKLQKILPTVPNSIAKTSIFKLFVFLHNVFLCLYSIWTFLGMSHTIATTMNLFEGNFLQSLVNYQPKKLDIFLHSVCDPKIGIFSRLLTNEKGLHNLEVFGWWFYISKFYEVLDTAIILLKGRPSSLLQSYHHAGAMMCMWAGIRYQSPPIWIFVVFNSFIHSLMYFYFSLSCLKIRVPNFFKRILTTMQITQFIVGGSIAILHSFVWIVDTSHVISPDNLKWVSCISTPDQALPILINVLYLLPLTALFTAFYIESYLKKKSA

SEQ ID NO: 77 - DNA, 978 bp, Yarrowia lipolytica
  CDS (1)..(978): C14/16 elongase
atgagcgccgtccctattgaattcaacgtcccctccgtggaccgaccctttggtatctacctctgggccatctttgaccaggcctgggagaagcttttcggctggcccgcgtcctctttcattttcgtgcgaaatgaccccaacatccccttttcctctacccctcccgtgatcattgccatcattgtgtactacattgtcatctttggcggccgagaggtgatgcgaaacctgtctcccatccgactcaactggctcttccagatccacaacatcttcctcacccttctgtccggtatgctcctcctcctcctcgttgagcagctcttccccatcattgtccgacagggtatcctctacgccatctgcgactacggatcttggactcagcccattgtcttctgctactacctcaactacctgaccaagtactttgagctgatcgacaccgttttccttgtgctgcgaaagaagaagctgactttcctccacacctaccaccatggtgccactgctcttctgtgctacacccagctcattggtaagacctcggtctcttgggtccccatcacccttaacctgtttgtccacgttgtcatgtacttctactacttcctggctgcgcgaggtatccgagtgtggtggaaggagtgggtcacccggctccagatcatccagttcgttatcgatcttggatttgtctactttgcctcttacacctacttcacctctacctactggccctggatgcccaacatgggctcttgtgccggcgaggagtttgctgctatttacggctgtggtctgctgacctcttacctcttcctcttcatcgccttctacatcaactcttaccgaaagccctcttccaagggaccttccaagcctgttgttgctgtcgatggccctgttggcggcgtcaacgcccagactggtgcttctcgaggccagaccactacccgatctcgacgagcataa

SEQ ID NO: 78 - protein, 325 aa, Yarrowia lipolytica
MSAVPIEFNVPSVDRPFGIYLWAIFDQAWEKLFGWPASSFIFVRNDPNIPFSSTPPVIIAIIVYYIVIFGGREVMRNLSPIRLNWLFQIHNIFLTLLSGMLLLLLVEQLFPIIVRQGILYAICDYGSWTQPIVFCYYLNYLTKYFELIDTVFLVLRKKKLTFLHTYHHGATALLCYTQLIGKTSVSWVPITLNLFVHVVMYFYYFLAARGIRVWWKEWVTRLQIIQFVIDLGFVYFASYTYFTSTYWPWMPNMGSCAGEEFAAIYGCGLLTSYLFLFIAFYINSYRKPSSKGPSKPVVAVDGPVGGVNAQTGASRGQTTTRSRRA

SEQ ID NO: 79 - protein, 337 aa, Neurospora crassa (GenBank Accession #CAD70918)
MATASPVSFLDSLPRPTLDRPFGIHLWPIFSKAFEAVVGYPAEDFRFVPGETPMSTLKETSIFIVIYYTIIFGGRELMRNREPFKLRTLFLIHNFYLTAISAILLALFIEQLLPIVVRGGIFHAICHIDGGWTQPLVVLYYLNYLTKYLELLDTCFLFLKKKPLTFLHCYHHGATALLCYTQLIGSTSVSWVPITLNLTVHVVMYWYYFQSARGIRIWWKEWITRLQIIQFIIDLGFVYFASYTYFTSTYFPWMPNAGKCAGEEFAAFSGIGILSSYLVLFISFYFATYKKDGKRPTGRKSLRRMSQAPLPDPKDIVSAKASGARPSGAATARSRKA

SEQ ID NO: 80 - DNA, 945 bp, Mortierella alpina
atgtccataggttcttccaatcctgtcctgctggcagcgatccccttcgtctacctcttcgtcctccctcgtgtcctcgccttcctccctcaaaaggcccagttcctcgcaaaatgcatcgtggtcttgatcgccacccttatcatgtccgtcgcaggctgcttcatttccatcgtctgtgcgctcctcgataaacgctatgtgatcaactacgtcgtctcaagactcttctcattcctcgctgcaagaccctgcggtgtcacctacaagatcgtcggcgaggaacatctggacaagtaccccgccattgtcgtctgcaaccaccagagctccatggacatgatggtcctgggacgcgtcttcccaaagcactgtgtcgtcatggcaaagaaggaacttctttactttccgttcctgggcatgtttatgaagctgagtaacgccatcttcattgaccgcaagaaccacaagaaggcgatcgagtccaccacccaagctgtcgccgacatgaagaagcacaactctggaatctggattttccccgaaggaacacgttcccgcttggacaaggccgatctcttgcccttcaagaagggagccttccacctcgccattcaagcccaactcccgatcctccccatcatctcgcaaggatactcacacatctacgattcgtcaaaacgctacttccccggtggagagctcgagatcagagtcctggaacctatccccaccacgggattgaccacagacgatgtgaacgacctgatggacaagactcgcaacctgatgctgaagcacctcaaggagatggattctcaatactcctcctccaccgctgaaaacggatcgacccatattgacgccgatatcgcaaagtcaactgccacatcgatcggaaacacggacgatgctatcacaaagaggaggacaccaaaagagtag

SEQ ID NO: 81 - protein, 314 aa, Mortierella alpina
MSIGSSNPVLLAAIPFVYLFVLPRVLAFLPQKAQFLAKCIVVLIATLIMSVAGCFISIVCALLDKRYVINYVVSRLFSFLAARPCGVTYKIVGEEHLDKYPAIVVCNHQSSMDMMVLGRVFPKHCVVMAKKELLYFPFLGMFMKLSNAIFIDRKNHKKAIESTTQAVADMKKHNSGIWIFPEGTRSRLDKADLLPFKKGAFHLAIQAQLPILPIISQGYSHIYDSSKRYFPGGELEIRVLEPIPTTGLTTDDVNDLMDKTRNLMLKHLKEMDSQYSSSTAENGSTHIDADIAKSTATSIGNTDDAITKRRTPKE

SEQ ID NO: 82 - DNA, 927 bp, Mortierella alpina
  misc_feature: LPAAT2
atgctcgggtccgtcacccgacccacaaaggccctgctctatggatcagccctcttcagtttctgctcattgctcaatgtggtccaggtgttctccatactcctgcagccgttctcgaagcgtctcttctttgaagtgaacgctcgcgtggccggctccatgtggaaggttatgcagctgattatggagaaaaagcacaaggccgccatcaycttctcaggagacaagatccctcaccacgagagtgccatcgtctttggcaaccaccggtcctttgtcgacttttacatgtttcacaccgttgctgctyggagaggcatgctcaactatatgaagtactttgccaaggactctctgaaatacattccattctatggatggggcatgtggaycatgggaatgctattcatcaatcgcaactggcagcaggatcagctcaagatcaacaagatgtttgcacggatattggacatccaagcgcccgtttgggtcgccagtttcttggagggctctcggttgacgcccagcaaactgkctgcctctcaaaagttcatgctgggacgcggattgcctctgctgtcaaacgtcatgatgcccaggaccaagggattcattgcctgtgtcaacaaattccggggaactcatgtgaaatgtgtttatgatttcacgttcgcctactaccacaagaccaagggctttggagtgyctccagatctggtccgtgttcacastggccagctcagccccgagtacaaattccatgttcatgtgagacgctatcagctcgacgatctgcccacggatgaggagaagctgagcgagtgggtggtccaaaagtatgtggagaaggacgcctttttggagcagatgaaggagaattggacagatggtattgatgggggtgtgtggtcagagaactggatgtga

SEQ ID NO: 83 - protein, 308 aa, Mortierella alpina
  misc_feature (71)..(71): Xaa can be any naturally occurring amino acid
  misc_feature (104)..(104): Xaa can be any naturally occurring amino acid
  misc_feature (131)..(131): Xaa can be any naturally occurring amino acid
  misc_feature (179)..(179): Xaa can be any naturally occurring amino acid
  misc_feature (236)..(236): Xaa can be any naturally occurring amino acid
  misc_feature (244)..(244): Xaa can be any naturally occurring amino acid
MLGSVTRPTKALLYGSALFSFCSLLNVVQVFSILLQPFSKRLFFEVNARVAGSMWKVMQLIMEKKHKAAIXFSGDKIPHHESAIVFGNHRSFVDFYMFHTVAAXRGMLNYMKYFAKDSLKYIPFYGWGMWXMGMLFINRNWQQDQLKINKMFARILDIQAPVWVASFLEGSRLTPSKLXASQKFMLGRGLPLLSNVMMPRTKGFIACVNKFRGTHVKCVYDFTFAYYHKTKGFGVXPDLVRVHXGQLSPEYKFHVHVRRYQLDDLPTDEEKLSEWVVQKYVEKDAFLEQMKENWTDGIDGGVWSENWM

SEQ ID NO: 84 - DNA, 1549 bp, Yarrowia lipolytica
  misc_feature: LPAAT1
  CDS (501)..(1349)
cacagcataataccacggcatgaccccgctgactccaaccttcatttcggcacatgtaggtgcacaagggacttcaagaggggccaatttcatgcggacacatggcgcaaaaaacgcccgactttgattacacagacacgtaataacgacgaagccgagatgagcacacgtggccaagtctgccaatggccccctggacccccctgacaaagtttcccaacaagcccagccgtgcatggtgtgtttttgtgcggagacacacgccaattaggctcatttgagggtatgcagcgaaaaaaaattagtgtgggtagtttgtttgcaggaatcaagtgggtggttgaaaaacaagaaagagcgacgacaagagagagagaaaaagagagagagactccataaagcgtgcatcaaaattaaggtgtgtgactatccgaaaaccaaacatgaacagttggatatatgtcgctgtgattgcagttgctgccgttctcattgcccgaatgtccgttgcatccaagctcgtcttctacgtccgcgccgccatcgccgtggtcatctttgccgcctgtgccacctacggcgtgctggcgtccaccattctcaccgccatcggcaagcagggcctggcccaatggaccgttgccagagccttctactactcggtgcgcatcttcctgggtatcagcatcaagctgcgtagccggcaggtgaccggaaccgccggtctggatgcctccaagatccaggtcgccaacaccaccaagcccattgacgacatcaccaaacacctgccccgaccatgcattctgatttccaaccaccagaacgaaatggacattctggtgctcggtcgcatcttcccccagtactgctccgtcaccgccaaaaaggccctcaagtggtaccctctgctgggccagttcatggcgctgtccggcaccatcttcctggaccgaaaggaccgaaccaagtccgtgcagaccctcggcggcgccgtcaagaccatccagagcggcaacggaggcaagggccagagcgtcttcatgttccccgagggaacccgatcctactccaaggacgtcggcatcatgcccttcaagaagggctgtttccacctggcggtccagtcgggcgctcccattgtccccgtggtggtccagaacacctcccgaatgttttctttcggccgaggcaagctggacgccggagagatccttgtcgacgtcctgagccccattgagaccaagggtctggacgccagcaacgtcgacgctctcatggccaccacttataaggccatgtgcgagactgccgaccagattggctacgctggccagaagactcagtagagactgcagcacaagaagtgcttgtagctactttaggagagagataggtaatatgaaacatttttcagatcgacacccacggcgaaccattggctgtggagctatgggtgaatggattaatatagcaacgaaatctacctcgattaccaacgcaaaacgagcccactttctctgtactgtgctatatcgtgtatacccca

SEQ ID NO: 85 - protein, 282 aa, Yarrowia lipolytica
MSVASKLVFYVRAAIAVVIFAACATYGVLASTILTAIGKQGLAQWTVARAFYYSVRIFLGISIKLRSRQVTGTAGLDASKIQVANTTKPIDDITKHLPRPCILISNHQNEMDILVLGRIFPQYCSVTAKKALKWYPLLGQFMALSGTIFLDRKDRTKSVQTLGGAVKTIQSGNGGKGQSVFMFPEGTRSYSKDVGIMPFKKGCFHLAVQSGAPIVPVVVQNTSRMFSFGRGKLDAGEILVDVLSPIETKGLDASNVDALMATTYKAMCETADQIGYAGQKTQ

SEQ ID NO: 86 - DNA, 1495 bp, Yarrowia lipolytica
  misc_feature: LPAAT2
tagagtactcatagctactgtattccataatcaaggttcactgtgcttcgatactgcctggagataagacagatgcgataatacacgacatgttggatgtaagggcatgtaatacgtgttgatattaattgatctgacgtattatataaacgatgtatatccaggactcattcaacactagacgcaacccgatgctctcgtcacaatgattggattcttggtctcggtctcaggttgcgtcttctttcggctcctctcaccacacttctttaacacccctcaacccaccaccattctattccacatcacctcacaccacttcaagagagataccgacacaatataatttcatcgatgaaactggaaaccagaaaatacctgctggtgaccatcctggtggtcatgttcactatcggctcggtcatggacctatggctctacctcctgtgtcttagccgatcacccaacctcaagcactacagagctatgttggctcgaagatggtggtcgtggacgatgttctcggtgggtcaggtggtcaacttcaagatcaagatgcacggcgacaaaatgatacccgagggaaacatgctgataatcagtgagatacctatgatgtggtcgacgagacacgaaatactaacacaggtaatcatctatcaagatacgactatatgatctacgcactaatcaacaaccagcattgcgccaagtcgcaccttgcattcctgtcctggaaacacatcttttctctctttagcctcagcaagattctgcccttctaccgacttgacgaaaactggatgttcgaatcagcagccgaccttgagaaagaactagccaagctaatcaacccttactgtctggtgctgttcccagaagtctcggtggcaaccccacaacttatcagacgacatagagagctctgcagagcgtgttttgcacctgaactcactcatgtactctaccctcgccacagcagctttgcagacttcatattgggactgaataagggccaggctcttagttacatctacgacgccaccatctcgtatactgacaagaaagataagattctatgtaatcctggaaacatagatactctgttgactcaagtggaaacggttcatgttcacatacaccgagaacagtatcgtcggctgccgcgccacagacgtggtattcagaagtggctggaaaacacatgggtccacaaggataagagtatcagaaaggcctacaagcagtctggatcaatcatggatgatggcaagctcaaggagaaggataagtgatactaactaactgcatgtaaaaacagataaatatgttaatgaatcaatgaaatggtatacgatgactacagtaaactctggtataccttacttgaatgtttttgataaatattattgacaacactatattgacaatgatgctatctagttgatgtgagccttcttctccagctcatcggcaagatcgtcaacggtcttgt

SEQ ID NO: 87 - DNA, 672 bp, Yarrowia lipolytica
atggtggtcgtggacgatgttctcggtaatcatctatcaagatacgactatatgatctacgcactaatcaacaaccagcattgcgccaagtcgcaccttgcattcctgtcctggaaacacatcttttctctctttagcctcagcaagattctgcccttctaccgacttgacgaaaactggatgttcgaatcagcagccgaccttgagaaagaactagccaagctaatcaacccttactgtctggtgctgttcccagaagtctcggtggcaaccccacaacttatcagacgacatagagagctctgcagagcgtgttttgcacctgaactcactcatgtactctaccctcgccacagcagctttgcagacttcatattgggactgaataagggccaggctcttagttacatctacgacgccaccatctcgtatactgacaagaaagataagattctatgtaatcctggaaacatagatactctgttgactcaagtggaaacggttcatgttcacatacaccgagaacagtatcgtcggctgccgcgccacagacgtggtattcagaagtggctggaaaacacatgggtccacaaggataagagtatcagaaaggcctacaagcagtctggatcaatcatggatgatggcaagctcaaggagaaggataagtga

SEQ ID NO: 88 - protein, 223 aa, Yarrowia lipolytica
MVVVDDVLGNHLSRYDYMIYALINNQHCAKSHLAFLSWKHIFSLFSLSKILPFYRLDENWMFESAADLEKELAKLINPYCLVLFPEVSVATPQLIRRHRELCRACFAPELTHVLYPRHSSFADFILGLNKGQALSYIYDATISYTDKKDKILCNPGNIDTLLTQVETVHVHIHREQYRRLPRHRRGIQKWLENTWVHKDKSIRKAYKQSGSIMDDGKLKEKDK

SEQ ID NO: 89 - DNA, 2326 bp, Yarrowia lipolytica
  misc_feature: PDAT
  misc_feature (2271)..(2271): n is a, c, g, or t
tattaatattatgctcttcatgcaccagcaaaataaccgaaacgcgcatatgatagtgggattctcgatttgcccggcagacaaacgccgctaaaatcgccacagtatcgaattttaattgaatacgaacgtcaattccggcttatccttctagcagttgtctcccgcagctcgctccatgactaatcattcacgcgacatgtctcagctaccccggtctggctcatgtaaaaaaagtgtaatcggcttttttccggttgatcacaaccatcaatgacacaacctgtgaatcggaaggcgactgtcgagcgggtcgagccagcagtggaggtggctgactccgagtccgaggccaagaccgacgtccacgttcaccaccatcatcaccaccacaagcgaaaatccgtcaagggcaagattctcaacttcttcacccgaagtcgacgtatcaccttcgtcctcggcgccgtggtcggtgtgatagccgcgggatactacgctgcgccaccggagctcagcattgatatcgatgctcttctcggcgacttgccctcgttcgactttgacgctctatctctcgacaacttgtccatggacagtgtgtcggactttgtacaagacatgaaatcgcggtttccgaccaagattctgcaggaggcggccaagatcgagaagcaccagaaaagcgaacagaaggctgccccttttgctgtgggcaaggctatgaagagcgagggactcaacgccaagtacccggtggtgctggtgcccggcgtcatctccacgggactggagagctggtccctggagggaaccgaggagtgtcccaccgagtcgcacttcagaaagcgaatgtggggctcctggtacatgatccgagtcatgctgctggacaagtactgctggctgcagaacctgatgctggacacagagaccggtctagaccctccccatttcaagctgcgagccgcccagggatttgcctccgccgacttctttatggcaggctactggctgtggaacaagctgctcgagaacctggctgttattggatacgatacggatacaatgtctgctgcggcgtacgactggagactgtcctaccctgatttggagcaccgagacggatacttctccaagctcaaagcttcaatcgaagagactaagcgtatgacaggtgagaagacagttctgacgggccattccatgggctcccaggtcatcttctacttcatgaagtgggctgaggccgagggatatggaggaggaggtcccaactgggtcaatgaccatattgaatcctttgtcgacatttccggctccatgctgggtactcccaagaccctggttgctcttctgtctggagaaatgaaggataccgtgcagctgaacgcgatggctgtgtatggactggagcagttcttctctcgacgagagcgagccgatctgctgcgaacatggggaggaattgcttccatgattcccaagggtggtaaggctatctggggtgatcattctggagcccctgatgacgagcccggccagaatgtcacctttggcaacttcatcaagttcaaggagtccttgaccgagtactctgctaagaacctcaccatggatgaaaccgttgacttcctgtattctcagtctcccgagtggtttgtgaaccgaaccgagggtgcttactcctttggaattgccaagactcgaaagcaggttgagcagaatgagaagcgaccttctacctggagcaaccctctggaagctgctctccccaatgcccccgatctcaagatctactgcttctatggagtcggtaaggataccgagcgagcctactactaccaggatgagcccaatcccgagcagaccaacttgaacgtcagtatcgctggaaacgaccctgatggtgtgcttatgggtcagggcgatggaaccgtctcccttgtgacccataccatgtgtcaccgatggaaggacgagaattccaagttcaaccctggtaacgcccaggtcaaggttgtggagatgttgcaccagcctgatcgacttgatattcgaggcggtgctcagactgccgagcatgtggacattctggggcgttctgagttgaacgagatggttctgaaggtggctagtggaaagggaaatgagattgaagagagagtcatctccaacattgatgagtgggtgtggaagattgatctcggcagcaattagagagtccgttttgtagagtaatatgttttgtatatcacactgatggagaanggcgttcgatttctcatgattccatgtggttgtttaatgagcacgtagaacgacg

SEQ ID NO: 90 - protein, 648 aa, Yarrowia lipolytica
MTQPVNRKATVERVEPAVEVADSESEAKTDVHVHHHHHHHKRKSVKGKILNFFTRSRRITFVLGAVVGVIAAGYYAAPPELSIDIDALLGDLPSFDFDALSLDNLSMDSVSDFVQDMKSRFPTKILQEAAKIEKHQKSEQKAAPFAVGKAMKSEGLNAKYPVVLVPGVISTGLESWSLEGTEECPTESHFRKRMWGSWYMIRVMLLDKYCWLQNLMLDTETGLDPPHFKLRAAQGFASADFFMAGYWLWNKLLENLAVIGYDTDTMSAAAYDWRLSYPDLEHRDGYFSKLKASIEETKRMTGEKTVLTGHSMGSQVIFYFMKWAEAEGYGGGGPNWVNDHIESFVDISGSMLGTPKTLVALLSGEMKDTVQLNAMAVYGLEQFFSRRERADLLRTWGGIASMIPKGGKAIWGDHSGAPDDEPGQNVTFGNFIKFKESLTEYSAKNLTMDETVDFLYSQSPEWFVNRTEGAYSFGIAKTRKQVEQNEKRPSTWSNPLEAALPNAPDLKIYCFYGVGKDTERAYYYQDEPNPEQTNLNVSIAGNDPDGVLMGQGDGTVSLVTHTMCHRWKDENSKFNPGNAQVKVVEMLHQPDRLDIRGGAQTAEHVDILGRSELNEMVLKVASGKGNEIEERVISNIDEWVWKIDLGSN

SEQ ID NO: 91 - DNA, 1632 bp, Yarrowia lipolytica
  misc_feature: ARE2
atggccacactccaccccgaagacgccgcaggacggcccgtgcgacgacgacctcgtccctccagttcgggcggctccagatcgccgtccaccaaacgacactcgatagtgcgggagcatctcggagaagagctcaatgtgcccgacggccaggaaatggacctgggccaggtcaacaagaacctcaatgccgcatacgccaaggccgagaaggactcggacgacgagaaggaaaagaaggaggagggcgtggtggacgagctgccagagaagtattcctaccctcgattctcaaagaacaaccgacgctacagattcaccgacatcaagttcaagccaacaccgtcgattctcgacaagttcgcccacaaggactcggagttctttggcttctacaccctgctgtggatggtgtttgccttctgcgtcttccgaaccggcctgctcaactacacaaacgaaggcatcctgttccggggccagattttcgccattctcagcaaagatctctggaaagtcgcattggtcgatctgggcatgtacctgaccacctatctgtctgtgtttctgcaattggccgtcaagcacggtctggtcgactggaactcgtttggctggatcatccagaacgtgcaccagaccctgttcctcttcttctacctttgggtcgccaagtcgagtaacctgccttggatcggtaacatcttcattgtgcttcatgcctttgtcatgctcatgaaacaacactcgtacgccttctacaatggctacctatggactgtcgaggacgagctctcccacgcaaagcagcgtctcaccgaagacattcctgtttcagagaaggaggatctcaagctggacatcgagttctgcgagacagagctcaaggtccaatccagacacacccctttccccaccaacatcaccttttctaactacttctggtactccatgttcccaacgctcgtctacgaaattgagttccctcgaaccccccgaatcaagtggacatacgtgctggagaaggtcgccgcagtctttggcgtcttcttccttatgatctgggtcgcagagtcgtacctgtatccccctgtggtggctgttattcaaatgcgagacgaacccttctggaacaaggtccgaatctatcccattttcctgtcggacattctgctgccctttgtcattgagtacatgcttgttttctacatcatctgggacgccattctcaacggcattgccgagctcactcgcttcgccgacagagacttttatggcccctggtggaactgtaccagctgggagcagtttagccgagaatggaacattcctgtctaccagttcctcaagcgacacgtctaccactcgtccatctctgctttcaagttctccaagggcgcagctaccctcaccaccttcttgctgtcttctcttgtccacgagctggtcatgtttgccatctttaagaagttccgaggatacctgctgttgctgcagatgacccagctgcccctggccatgctgcagaaaaccaaatggatccaggacagacccgtttttggcaacgctttcttctggttctcgctcatgatcggaccttctctcatgtgttccatgtacctcctcttctaa

SEQ ID NO: 92 - protein, 543 aa, Yarrowia lipolytica
MATLHPEDAAGRPVRRRPRPSSSGGSRSPSTKRHSIVREHLGEELNVPDGQEMDLGQVNKNLNAAYAKAEKDSDDEKEKKEEGVVDELPEKYSYPRFSKNNRRYRFTDIKFKPTPSILDKFAHKDSEFFGFYTLLWMVFAFCVFRTGLLNYTNEGILFRGQIFAILSKDLWKVALVDLGMYLTTYLSVFLQLAVKHGLVDWNSFGWIIQNVHQTLFLFFYLWVAKSSNLPWIGNIFIVLHAFVMLMKQHSYAFYNGYLWTVEDELSHAKQRLTEDIPVSEKEDLKLDIEFCETELKVQSRHTPFPTNITFSNYFWYSMFPTLVYEIEFPRTPRIKWTYVLEKVAAVFGVFFLMIWVAESYLYPPVVAVIQMRDEPFWNKVRIYPIFLSDILLPFVIEYMLVFYIIWDAILNGIAELTRFADRDFYGPWWNCTSWEQFSREWNIPVYQFLKRHVYHSSISAFKFSKGAATLTTFLLSSLVHELVMFAIFKKFRGYLLLLQMTQLPLAMLQKTKWIQDRPVFGNAFFWFSLMIGPSLMCSMYLLF

SEQ ID NO: 93 - protein, 282 aa, Caenorhabditis elegans (clone TO6E8.1)
  misc_feature: LPCAT
  ref <310>: PATENT DOCUMENT NUMBER: WO 2004/076617A2
  ref <311>: PATENT FILING DATE: 2004-01-29
  ref <312>: PUBLICATION DATE: 2004-09-10
MENFWSIVVFFLLSILFILYNISTVCHYYMRISFYYFTILLHGMEVCVTMIPSWLNGKGADYVFHSFFYWCKWTGVHTTVYGYEKTQVEGPAVVICNHQSSLDILSMASIWPKNCVVMMKRILAYVPFFNLGAYFSNTIFIDRYNRERAMASVDYCASEMKNRNLKLWVFPEGTRNREGGFIPFKKGAFNIAVRAQIPIIPVVFSDYRDFYSKPGRYFKNDGEVVIRVLDAIPTKGLTLDDVSELSDMCRDVMLAAYKEVTLEAQQRNATRRGETKDGKKSE

SEQ ID NO: 94 - DNA, 1578 bp, Yarrowia lipolytica
  misc_feature: DGAT1
atggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccag

SEQ ID NO: 95 - protein, 526 aa, Yarrowia lipolytica
  misc_feature (518)..(518): Xaa can be any naturally occurring amino acid
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYXAYNYKQNQ

SEQ ID NO: 96 - DNA, 1578 bp, Mortierella alpina
  misc_feature: DGAT1
  misc_feature (466)..(466): n is a, c, g, or t
atgacagagtcgacaacaacgacatgtgcaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgtgncagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcctcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttga

SEQ ID NO: 97 - protein, 525 aa, Mortierella alpina
  misc_feature (156)..(156): Xaa can be any naturally occurring amino acid
MTESTTTTCAKEEGIANSAALPDIPPKMEDLKSSRKTGSSYKHTFPVHTKTIPSPLSKEAPPESYRGFVNLGMLLLFGNNIRLIIENYLKYGFLLSIPGSSVSKQDWILAALTHAILPVNLILAYKLESWAKERAVGYRKRRSDEPIAQESTKAVXAGDNDAIKTTKPAKAQDLTPEALARKEQSTVGWLHVFNLFTIVAWPSFMSYFMIYHPFVAMSCLMNGLILFLKMTSFALVNQELRAAYIFGTPVDTFQHMAKVHDISGKDLTKKEIFQYDIQYPDNITLKNIGYFWLAPTLCYQPSYPRTTVFRKSFFLKRVAEIVTCLGMMYFLVEQYATPTLQNSVRAFDELAFGTILERVLKLSTTSVIIWLLMFYTFFHSFFNALAEALYFGDRRFYLAWWNATGVGMYWKTWNSPVYTFFKRHVYLPLITSGTSPMVASIVIFLISAVLHEILIGFPTHMIYGYAFAGMFLQIPLIILTRPLEKWRGTGSGLGNMIFWVSFTILGQPACALLYYYHWTKRHMDV

SEQ ID NO: 98 - protein, 533 aa, Neurospora crassa strain OR74A [GenBank Accession No. XP_322121]
  misc_feature: DGAT1
MSSSTATTTGLDPAVHTSNDNVIRRTHGTENGSTPNDKANAGGEPETETKRHSKKVVRSKYRHVEAVHSQSRPSCLSHDTTESPSFLGFRNLMVIVLANNSHQYGVLICIGCHDFRKSDINLGLLLYFLIPCHLFIAYIIEYYAAVQARAERNVSASEQNAKEHQHQDGTNSPTEEQHRKFQSTWKLVRLLHAINVTTALVLTSYVVYYHIHHPLIGTLTEVHAIVVWLKTASYAFTNRDLRHAYLHPARGELDALPGLYAECPYPENITMGNLCYFWWAPTLVYQPVYPRTAKIRWSFVAKRCGEVICLSVFIWFLSAQYATPVLRNSLDKIASLDIPSIVERLLKLSTISLIIWLAGFFALFQSFLNALAEVTRFADRSFYDEWWNSESLGVYWRTWNKPVYQYFKRHVYSPMRSRGWSNATASLAVFFLSAVLHELLVGVPTHNLIGVAFLGMFLQLPLIQFTKPLEKKTSPNGKLLGNIIFWVSFTIFGQPFAALMYFYAWQAKYGSVSKMTTSQQLVQQGQGTCPPLV

SEQ ID NO: 99 - protein, 499 aa, Gibberella zeae PH-1 [GenBank Accession No. EAA77624]
  misc_feature: DGAT1
MNSATTTSTETSNGSTSVSKRNGHDVTRTNGNGTTTTSPPKKAGQKYRHVAAVHKKTRPSCLSHDSDAAPSFIGFRNLMVIVLGIYHIGMSQFDSEQPIDTASYRQDIFLGLLLYFLIPCHLLAAYLIELAAAQQARGSLKRYNDSASGGPSDQERKKFHKTWVIVAWAHLFNITLALVLTTWVVYFKIHHPLIGTLTEMHAIAVWLKTASYAFTNRDLRHAYLHPVEGERELVPELYTQCPYPQNITFSNLAYFWWAPTLVYQPVYPRTDKIRWGFVAKRVGEIFGLSVFIWVASAQYAAPVLRNSLDKIASLDLMSILERLLKLSTISLAIWLAGFFALFQSFLNALAEVLRFGDRSFYDDWWNSESLGAYWRTWNKPVYTYFKRHLYMPMIGRGWSPQAASFFVFLVSAILHEILVGVPTHNIIGVAFLGMFLQLPLIHLTKPLENMKLGHTGKIVGNTIFWVSFTIFGQPFAALMYFYAWQAKYGSVTDSGFSIS

SEQ ID NO: 100 - protein, 503 aa, Magnaporthe grisea 70-15 [GenBank Accession No. EAA52634]
  misc_feature: DGAT1
MAAATATGLDLAAQEGAQQRRSTATNQSADDDVTTNADGAAAAPSLKGTTADTNGTSNGNGNGNGNVDEDEQTKALRKAFTRKYRHVAALHSQARPSTLSHDSEASPSFVGFRNLMVIVLELLAAQQARNSRGYFNRGRTGSSRDGSTSPTEDESRRFVSTWKLIALVHGINVNSALLITTYTVYFHIHHPLIGTLTEMHAVIVWLKTASYAFTNRDLRHAYLHPVKGELDALPELYKQCPYPNNITMKNLCYFWWAPTLIYQPVYPRSGRIRWVFFFKRVAEVFCLSVCIWFLSAQYATPVLVNSLDKIASLDMPAILERLLKLSTISLAIWLAGFFALFQSFLNALAEITRFGDRSFYEAWWNSESLGVYWRTWNKPVYQYFKRHVYSPMLGRGWAPRTASASVFLISAVLHEILVGVPTHNIIGVAFMGMFLQVPLIILTAPLEKRKSPTGKLIGNSIFWVSFTIFGQPLAALMYFYAWQAKYGSVSKMGYATSKAALTN

SEQ ID NO: 101 - protein, 458 aa, Aspergillus nidulans FGSC A4 [GenBank Accession No. EAA57945]
  misc_feature: DGAT1
MATRKTAIYRHAVAVHSQVQHSCLSRDSTKATSFIGFRNLMVVVLVAMNLRLVIENFLKYGVLICIRCHDYRKQDVVIGAILFALVPCQLLCSYFIELAASRHAQRVIGRAKKQDKDRILNESKRTWFAIALLHSIISFFGLAATSYVIFYYVNHPGIGTVCEVQVIIVSLKSYSYALTNRDLRRAMLGSPSADSDIPELYRSCPYPRNITLGNLAYFLWAPTLVYQPVYPRTPRIRWSFVGKRLFEFVCLSVVMWLLSAQYAAPLLRNATQKIATLDIASILERGLKLSTISLVIWLAGFYALFQSLLNGLAEIMRFGDREFYTDWWNSPSFGVYWRSWNRPVYIFMKRHVYMPLVTRGWNPTLAGTVVFAVSAVLHEILVGVPTHNLIGVASIAMMFQLPLILLTAPFERFKSPLGKAIGNSFFWVTFCVVGQPLGALLYFFAWQAKYGSVSQTHP

SEQ ID NO: 102 - DNA, 2119 bp, Yarrowia lipolytica
  CDS (291)..(1835): DGAT2 opening reading frame, comprising 2 smaller internal opening reading frames
  misc_feature (291)..(293): initiation codon ('ATG')
  misc_feature (456)..(458): initiation codon ('ATG')
  misc_feature (768)..(770): initiation codon ('ATG')
aaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagctatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaaggaaaactgcctgggttaggcaaatagctaatgagtatttttttgatggcaaccaaatgtagaaagaaaaaaaaaaaaaaagaaaaaaaaaagagaatattatatctatgtaattctattaaaagctctgttgagtgagcggaataaatactgttgaagaggggattgtgtagagatctgtttactcaatggcaaactcatctgggggagatccttccactgtgggaagctcctggatagcctttgcatcggggttcaagaagaccattgtgaacagcccttga

SEQ ID NO: 103 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 104 - DNA, 1380 bp, Yarrowia lipolytica
  misc_feature: DGAT2
atgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 105 - protein, 459 aa, Yarrowia lipolytica
MLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 106 - DNA, 1068 bp, Yarrowia lipolytica
  misc_feature: DGAT2
atgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 107 - protein, 355 aa, Yarrowia lipolytica
MKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 108 - DNA, 996 bp, Mortierella alpina
  misc_feature: DGAT2
atgccgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtattgtaactggatcggatggaaacactttgcacagtactttcctatgacccttgtcaaggagggagagctggacccatccaagaactacatctttgggtatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcctttgtcaatggcgcaagtctggtacctacgttggcctttggtgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaatag

SEQ ID NO: 109 - protein, 331 aa, Mortierella alpina
MPLFAPLRMPVKRRMQTGAVLYWIAGMIYCIGIFAFLCTFKILRPLIIIYVLWAYMLDRAPERGARTVQWYCNWIGWKHFAQYFPMTLVKEGELDPSKNYIFGYHPHGIISLGALCAFGTEGLHFSKRFPGIKPHLLTIHANFQIPLYRDMIMAHGCASVSRASCEHILRSGEGSSVVIVVGGAQESLSTQPGTLNLTLKKRLGFCKLAFVNGASLVPTLAFGENELYEVYHTKPTSLIYKLQQLTKRTIGFTMPVFNGRGIFNYEFGLLPRRKPVYIVIGNPIHVDKVENPTIEQMQKLQSIYIDEVLNIWERYKDKYAAGRTQELCIIE

SEQ ID NO: 110 - DNA, 2151 bp, Mortierella alpina
atggcccttcagatctacgactttgtgtcgttcttcttcactatcctgctcgacatcttcttcagggagattcgtcccagaggcgcacacaagattccacaaaaaggccccgtgatctttgtcgccgctcctcatgccaatcagtttgtcgatcctctcgtcttgatgcgagagtgcggccgcagagtctcattccttgcagccaaaaagtccatggaccgccggtggattggtgcaatggcacgctcgatgaatgcgattcctgttgagcgcccccaggaccttgctaaagccggctcgggaatcatcaaacttctggatcgttatggcgaccctcttcgggtcaccggtgtcggcactaaattcacaaaggagctgcttgtgggcgaccagatctcccttccaaaggacgtcggtgtcycagctgtgggcgagatcatatctgataccgagctgattgtcaagaaggaattcaaagagctcaaggcccttgagttgctgaccagtgctgaaggaaccaagtacaaatgcctaccccatatggaccagacgaacgtctacaaaactgtctttgagcgccttaacgcaggacattgcgttggcattttccccgagggaggctcccacgatcgtgctgaaatgctgccattgaaagctggagtcaccatcatggccctgggcgcattagccgccaacccttccttggatctcaagattgtcacctgcggcctcaactactttcacccgcatcgcttccgctcgcgtgcagtagtcgagtttggcgagccattgacggtttcgcctgagctggtcgaaatgtacaagcgaggcggggcggaaaagcgagaggcttgcggaaaactgctcgacacgatctatgaagctctccgcggtgtcactctcaacgcgcctgattacgagacattgatggtcattcaagcggcccgtcgcctttacaagcctactcatcgcaagctgcagatctcgcaggtcgttgagttgaaccgtaggttcgtcgcaggatacatgcacttcaaggacaatccaaaagtcattgaagccaaggataaagtcatgcattacaacactcagctgcggtaccatggattgcgggatcaccaagtgaatattcgcaccaccaggaagcacgctatcggcatgctcatctctcggctgatccagatgatctttttgagttgtctggcgctacctggaactctgatgaatcttccggtcgccattgtcgctcgtgtcatcagcaacaaaaaggccaaagaggcgctggctgcctcgacagtcaaaattgctggaagggacgtcttggctacgtggaagttgctggtcgctctaggattgatgcctgttctgtacttcacgtactccgtcatggtcttcatctattgcagccgcttcgacctatcgttcaagtcgcgtcttttggttgcttgggcagcatgggcgcttattccttttgtaacctacgcaagcatccgctttggtgaagttggtatcgatatcttcaagtctattcgcccattgttcctgtccatcatcccgggcgaggagagcacgatcaacgacctgcgcaaggcgcgcgcagaacttcaaaagaccatcaccaatctcatcaatgagctagcgccgcagatatatcccgactttgattcaaagcgcatcctcgatccatcccctgcagatcgtcccagccgctcagcatcaggcaccaaccttgcacagacgattttcaacacggctgctcagcccttgaaccaatggctaggcaaggatggccgctttgaatgggagcgtaccgaggactctgatgcagatgacgtgttcttctttttggacccagcgagaggaattatggggcggtctagggcgtcgtcttggggaggtggagcatttacgcctgctgttgatgggtcgcgatcccggaatcggagcaggacaagcagcttcacgtcgggccagatccagctgggcgagggcttcaaactcgaggcactgacggagctgccgcgggacaacccttttgcagaagtgaccaggcggttgagtgtgagccgaatgcagagatatgggctggagggtatgacgcgctcggatacggatgaaaacgaaggccccgccaagtcaaaagacatttag

SEQ ID NO: 111 - protein, 716 aa, Mortierella alpina
  misc_feature (141)..(141): Xaa can be any naturally occurring amino acid
MALQIYDFVSFFFTILLDIFFREIRPRGAHKIPQKGPVIFVAAPHANQFVDPLVLMRECGRRVSFLAAKKSMDRRWIGAMARSMNAIPVERPQDLAKAGSGIIKLLDRYGDPLRVTGVGTKFTKELLVGDQISLPKDVGVXAVGEIISDTELIVKKEFKELKALELLTSAEGTKYKCLPHMDQTNVYKTVFERLNAGHCVGIFPEGGSHDRAEMLPLKAGVTIMALGALAANPSLDLKIVTCGLNYFHPHRFRSRAVVEFGEPLTVSPELVEMYKRGGAEKREACGKLLDTIYEALRGVTLNAPDYETLMVIQAARRLYKPTHRKLQISQVVELNRRFVAGYMHFKDNPKVIEAKDKVMHYNTQLRYHGLRDHQVNIRTTRKHAIGMLISRLIQMIFLSCLALPGTLMNLPVAIVARVISNKKAKEALAASTVKIAGRDVLATWKLLVALGLMPVLYFTYSVMVFIYCSRFDLSFKSRLLVAWAAWALIPFVTYASIRFGEVGIDIFKSIRPLFLSIIPGEESTINDLRKARAELQKTITNLINELAPQIYPDFDSKRILDPSPADRPSRSASGTNLAQTIFNTAAQPLNQWLGKDGRFEWERTEDSDAGDVFFFLDPARGIMGRSRASSWGGGAFTPAVDGSRSRNRSRTSSFTSGQIQLGEGFKLEALTELPRDNPFAEVTRRLSVSRMQRYGLEGMTRSDTDENEGPAKSKDI

SEQ ID NO: 112 - DNA, 1212 bp, Mortierella alpina
ccgcatgccaatcagtttgtcgatcctctcgtcttgatgcgagagtgcggccgcagagtctcattccttgcagccaaaaagtccatggaccgccggtggattggtgcaatggcacgctcgatgaatgcgattcctgttgagcgtccccaggaccttgctaaagccggctcgggaatcatcaaacttctggatcgttatggcgaccctcttcgggtcaccggtgtcggcactaaattcacaaaggagctgcttgtgggcgaccagatctcccttccaaaggacgtcggtgtcycagctgtgggcgagatcatatctgataccgagctgattgtcaagaaggaattcaaagagctcaaggcccttgagttgctgaccagtgctgaaggaaccaagtacaaatgcctaccccatatggaccagacgaacgtctacaaaactgtctttgagcgccttaacgcaggacattgcgttggcattttccccgagggaggctcccacgatcgtgctgaaatgctgccattgaaagctggagtcaccatcatggccctgggcgcattagccgccaacccttccttggatctcaagattgtcacctgcggcctcaactactttcacccgcatcgcttccgctcgcgtgcagtagtcgagtttggcgagccattgacggtttcgcctgagctggtcgaaatgtacaagcgaggcggggcggaaaagcgagaggcttgcggaaaactgctcgacacgatctatgaagctctccgcggtgtcactctcaacgcgcctgattacgagacattgatggtcattcaagcggcccgtcgcctttacaagcctactcatcgcaagctgcagatctcgcaggtcgttgagttgaaccgtaggttcgtcgcaggatacatgcacttcaaggacaatccaaaagtcattgaagccaaggataaagtcatgcattacaacactcagctgcggtaccatggattgcgggatcaccaagtgaatattcgcaccaccaggaagcacgctatcggcatgctcatctctcggctgatccagatgatctttttgagttgtctggcgctacctggaacyctgatgaatcttccggtcgccattgtcgctcgtgtcatcagcaacaaaaaggccaaagaggcgctggctgcctcgacagtcaaaattgctggaagggacgacatggcyacatggaaaagggcg

SEQ ID NO: 113 - DNA, 3935 bp, Mortierella alpina
  misc_feature (1051)..(1053): ATG translation initiation codon
  Intron (1195)..(1469)
  misc_feature (1379)..(1379): n is a, c, g, or t
  misc_feature (1381)..(1381): n is a, c, g, or t
  Intron (1585)..(1839)
  Intron (2795)..(2877)
  Intron (2940)..(3038)
  misc_feature (3911)..(3913): TAG stop codon
actatagggcacgcgtggtcgacggcccgggctggtccttgaccctcgttctatgaatatgcattacgacaaaagaaaatgaaaaaaaaagagcacgcgagcaggagcgcggttgtcaattttcaagcctacctcactcctgtcatgtcgcgccattttctttctttttctcgtctcacgatctctttgatcgaccagagtcgaatagaatatgaacatgatcaacctaattgcgcgagagtgagccattattgactatcagaccggggagcatgcagcctgatgcagcaaaaatttgagctgtgcacaatatttgtcatacataaaagtcggcccacatgtccaacagggcggggtggcctgaacacccaacgtgagaatatggacctgactgctcacaccatcgataccgaggattgccgcatgcactcagctgccgtagacacgcaccatataccatgtgataacggatctggctgtggtgtacccaggggcgatatacgcgcgcgtccctgcggacttgacgtgttaacgactctgtatgtggctctgatgatgcatcgggtgcattgaggctacggccgaggcggcaatcgagacgatgccattctctcttttggacggagaaagagaaggaggaaggaaagcgaggccgagggacggaggaacgaggaagagagagcgagaggwagcgagagcgaaggcgacgggctgtccaatggagcgcgtagagggtgatttgggttcgctctgccatactttattcgcctgcatattcaccacccgctgcatctttgcagtgtttgccctcttccttttccttttccttttcttttttcttttttcgtctttctgcccctcatccgcatctcccctgtcgcccattacctgctcgctttccacccctgtttgcacacctaccccagcccaatcctgtcctagcgcactctctctgcccgtccgcacgtttcttctatggccctctaggcgcctttttgctgcccattctctattgtccacttacccacgcaggcacggccgagtccagtcatggcccttcagatctacgactttgtgtcgttcttcttcactatcctgctcgacatcttcttcagggagattcgtcccagaggcgcacacaagattccacaaaaaggccccgtgatctttgtcgccgctcctcatgccaatcaggtacgtgcacgcaggcgttgttttctcggaccctacctcgtcaaatagctgtacacgctggaatgagagcgcataatcgcctggacacgggtgcagagttcatgcacgataagccgaacagcgggagccgacactccaaaagacctcaggactaggggaaaaaaaaaaaaaaaaaaaaaaaaaananctggactcgattagccctattcccaagggtgggggttcgtcattggttgtcgcaaacatcccaacttacagcactcttgtcctcatagtttgtcgatcctctcgtcttgatgcgagagtgcggccgcagagtctcattccttgcagccaaaaagtccatggaccgccggtggattggtgcaatggcacgctcgatgaatgcgagtaagttgctaggattcccaccctcccggctttattttgcagctctctcatacacgtacacacacacacacaaagaagattctcgatggtcactggatgctttggtggtgctgtcgaaagggctgcagactcttgctgtgtggtgatagagtgccggctttgatcccccatcgaccgtttgggtccctcaccaagacatcagccctgagagcagattaattgatctgatactgttgaatcgttttctacccatagttcctgttgagcgcccccaggaccttgctaaagccggctcgggaatcatcaaacttctggatcgttatggcgaccctcttcgggtcaccggtgtcggcactaaattcacaaaggagctgcttgtgggcgaccagatctcccttccaaaggacgtcggtgtcycagctgtgggcgagatcatatctgataccgagctgattgtcaagaaggaattcaaagagctcaaggcccttgagttgctgaccagtgctgaaggaaccaagtacaaatgcctaccccatatggaccagacgaacgtctacaaaactgtctttgagcgccttaacgcaggacattgcgttggcattttccccgagggaggctcccacgatcgtgctgaaatgctgccattgaaagctggagtcaccatcatggccctgggcgcattagccgccaacccttccttggatctcaagattgtcacctgcggcctcaactactttcacccgcatcgcttccgctcgcgtgcagtagtcgagtttggcgagccattgacggtttcgcctgagctggtcgaaatgtacaagcgaggcggggcggaaaagcgagaggcttgcggaaaactgctcgacacgatctatgaagctctccgcggtgtcactctcaacgcgcctgattacgagacattgatggtcattcaagcggcccgtcgcctttacaagcctactcatcgcaagctgcagatctcgcaggtcgttgagttgaaccgtaggttcgtcgcaggatacatgcacttcaaggacaatccaaaagtcattgaagccaaggataaagtcatgcattacaacactcagctgcggtaccatggattgcgggatcaccaagtgaatattcgcaccaccaggaagcacgctatcggcatgctcatctctcggctgatccagatgatctttttgagttgtctggcgctacctgggtaagagcatttttctatatcgacaagggtctctagtgagttggctacggaatggtcactaacgcatgcttttgccaatacagaactctgatgaatcttccggtcgccattgtcgctcgtgtcatcagcaacaaaaaggccaaaggtatacttttttttttttttttttttttttttcgcctttgtgttttgtgctcgacctgtgaaaactaatttatttcttccttcgttctgccaccggtagaggcgctggctgcctcgacagtcaaaattgctggaagggacgtcttggctacgtggaagttgctggtcgctctaggattgatgcctgttctgtacttcacgtactccgtcatggtcttcatctattgcagccgcttcgacctatcgttcaagtcgcgtcttttggttgcttgggcagcatgggcgcttattccttttgtaacctacgcaagcatccgctttggtgaagttggtatcgatatcttcaagtctattcgcccattgttcctgtccatcatcccgggcgaggagagcacgatcaacgacctgcgcaaggcgcgcgcagaacttcaaaagaccatcaccaatctcatcaatgagctagcgccgcagatatatcccgactttgattcaaagcgcatcctcgatccatcccctgcagatcgtcccagccgctcagcatcaggcaccaaccttgcacagacgattttcaacacggctgctcagcccttgaaccaatggctaggcaaggatggccgctttgaatgggagcgtaccgaggactctgatgcagatgacgtgttcttctttttggacccagcgagaggaattatggggcggtctagggcgtcgtcttggggaggtggagcatttacgcctgctgttgatgggtcgcgatcccggaatcggagcaggacaagcagcttcacgtcgggccagatccagctgggcgagggcttcaaactcgaggcactgacggagctgccgcgggacaacccttttgcagaagtgaccaggcggttgagtgtgagccgaatgcagagatatgggctggagggtatgacgcgctcggatacggatgaaaacgaaggccccgccaagtcaaaagacatttaggaataaacgcccgtatttcccc

SEQ ID NO: 114 - DNA, 965 bp, Mortierella alpina
cattgtcgctcgtgtcatcagcaacaaaaaggccaaagaggcgctggctgcctcgacagtcaaaattgctggaagggacgtcttggctacgtggaagttgctggtcgctctaggattgatgcctgttctgtacttcacgtactccgtcatggtcttcatctattgcagccgcttcgacctatcgttcaagtcgcgtcttttggttgcttgggcagcatgggcgcttattccttttgtaacctacgcaagcatccgctttggtgaagttggtatcgatatcttcaagtctattcgcccattgttcctgtccatcatcccgggcgaggagagcacgattaacgacctgcgcaaggcgcgcgcagaacttcaaaagaccatcaccaatctcatcaatgagctagcgccgcagatatatcccgactttgattcaaagcgcatcctcgatccatcccctgcagatcgtcccagccgctcagcatcaggcaccaaccttgcacagacgattttcaacacggctgctcagcccttgaaccaatggctaggcaaggatggccgctttgaatgggagcgtaccgaggactctgatgcaggtgacgtgttcttctttttggacccagcgagaggaattatggggcggtctagggcgtcgtcttggggaggtggagcatttacccctgctgttgatgggtcgcgatcccggaatcggagcaggacaagcagcttcacgtcgggccagatccagctgggcgagggcttcaaactcgaggcactgacggagctgccgcgggacaacccttttgcagaagtgaccaggcggttgagtgtgagccgaatgcagagatatgggctggagggtatgacgcgctcggatacggatgaaaacgaaggccccgccaagtcaaaagacatttaggaataaacgcccgtatttccccaaaaaaaaaaaaaaaaaaaaaaaaaaaaaa

SEQ ID NO: 115 - DNA, 1908 bp, Mortierella alpina
  misc_feature (1051)..(1053): ATG translation initiation codon
  Intron (1195)..(1469)
  misc_feature (1379)..(1379): n is a, c, g, or t
  misc_feature (1381)..(1381): n is a, c, g, or t
  Intron (1585)..(1839)
actatagggcacgcgtggtcgacggcccgggctggtccttgaccctcgttctatgaatatgcattacgacaaaagaaaatgaaaaaaaaagagcacgcgagcaggagcgcggttgtcaattttcaagcctacctcactcctgtcatgtcgcgccattttctttctttttctcgtctcacgatctctttgatcgaccagagtcgaatagaatatgaacatgatcaacctaattgcgcgagagtgagccattattgactatcagaccggggagcatgcagcctgatgcagcaaaaatttgagctgtgcacaatatttgtcatacataaaagtcggcccacatgtccaacagggcggggtggcctgaacacccaacgtgagaatatggacctgactgctcacaccatcgataccgaggattgccgcatgcactcagctgccgtagacacgcaccatataccatgtgataacggatctggctgtggtgtacccaggggcgatatacgcgcgcgtccctgcggacttgacgtgttaacgactctgtatgtggctctgatgatgcatcgggtgcattgaggctacggccgaggcggcaatcgagacgatgccattctctcttttggacggagaaagagaaggaggaaggaaagcgaggccgagggacggaggaacgaggaagagagagcgagaggwagcgagagcgaaggcgacgggctgtccaatggagcgcgtagagggtgatttgggttcgctctgccatactttattcgcctgcatattcaccacccgctgcatctttgcagtgtttgccctcttccttttccttttccttttcttttttcttttttcgtctttctgcccctcatccgcatctcccctgtcgcccattacctgctcgctttccacccctgtttgcacacctaccccagcccaatcctgtcctagcgcactctctctgcccgtccgcacgtttcttctatggccctctaggcgcctttttgctgcccattctctattgtccacttacccacgcaggcacggccgagtccagtcatggcccttcagatctacgactttgtgtcgttcttcttcactatcctgctcgacatcttcttcagggagattcgtcccagaggcgcacacaagattccacaaaaaggccccgtgatctttgtcgccgctcctcatgccaatcaggtacgtgcacgcaggcgttgttttctcggaccctacctcgtcaaatagctgtacacgctggaatgagagcgcataatcgcctggacacgggtgcagagttcatgcacgataagccgaacagcgggagccgacactccaaaagacctcaggactaggggaaaaaaaaaaaaaaaaaaaaaaaaaananctggactcgattagccctattcccaagggtgggggttcgtcattggttgtcgcaaacatcccaacttacagcactcttgtcctcatagtttgtcgatcctctcgtcttgatgcgagagtgcggccgcagagtctcattccttgcagccaaaaagtccatggaccgccggtggattggtgcaatggcacgctcgatgaatgcgagtaagttgctaggattcccaccctcccggctttattttgcagctctctcatacacgtacacacacacacacaaagaagattctcgatggtcactggatgctttggtggtgctgtcgaaagggctgcagactcttgctgtgtggtgatagagtgccggctttgatcccccatcgaccgtttgggtccctcaccaagacatcagccctgagagcagattaattgatctgatactgttgaatcgttttctacccatagttcctgttgagcgcccccaggaccttgctaaagccggctcgggaatcatcaaacttctggatcgttatg

SEQ ID NO: 116 - DNA, 966 bp, Mortierella alpina
  Intron (19)..(101)
  Intron (164)..(262)
ttgtctggcgctacctgggtaagagcatttttctatatcgacaagggtctctagtgagttggctacggaatggtcactaacgcatgcttttgccaatacagaactctgatgaatcttccggtcgccattgtcgctcgtgtcatcagcaacaaaaaggccaaaggtatacttttttttttttttttttttttttttcgcctttgtgttttgtgctcgacctgtgaaaactaatttatttcttccttcgttctgccaccggtagaggcgctggctgcctcgacagtcaaaattgctggaagggacgtcttggctacgtggaagttgctggtcgctctaggattgatgcctgttctgtacttcacgtactccgtcatggtcttcatctattgcagccgcttcgacctatcgttcaagtcgcgtcttttggttgcttgggcagcatgggcgcttattccttttgtaacctacgcaagcatccgctttggtgaagttggtatcgatatcttcaagtctattcgcccattgttcctgtccatcatcccgggcgaggagagcacgatcaacgacctgcgcaaggcgcgcgcagaacttcaaaagaccatcaccaatctcatcaatgagctagcgccgcagatatatcccgactttgattcaaagcgcatcctcgatccatcccctgcagatcgtcccagccgctcagcatcaggcaccaaccttgcacagacgattttcaacacggctgctcagcccttgaaccaatggctaggcaaggatggccgctttgaatgggagcgtaccgaggactctgatgcagatgacgtgttcttctttttggacccagcgagaggaattatggggcggtctagggcgtcgtcttggggaggtggagcatttacgcctgctgttgatgggtcgcgatcccggaatcggagcaggacaagcagcttcacgtcgggccagatccag

SEQ ID NO: 117 - DNA, 275 bp, Mortierella alpina
  Intron (1)..(275)
  Intron (1)..(275)
  misc_feature (185)..(185): n is a, c, g, or t
  misc_feature (187)..(187): n is a, c, g, or t
gtacgtgcacgcaggcgttgttttctcggaccctacctcgtcaaatagctgtacacgctggaatgagagcgcataatcgcctggacacgggtgcagagttcatgcacgataagccgaacagcgggagccgacactccaaaagacctcaggactaggggaaaaaaaaaaaaaaaaaaaaaaaaaananctggactcgattagccctattcccaagggtgggggttcgtcattggttgtcgcaaacatcccaacttacagcactcttgtcctcatag

SEQ ID NO: 118 - DNA, 255 bp, Mortierella alpina
  Intron (1)..(255)
  Intron (1)..(255)
gtaagttgctaggattcccaccctcccggctttattttgcagctctctcatacacgtacacacacacacacaaagaagattctcgatggtcactggatgctttggtggtgctgtcgaaagggctgcagactcttgctgtgtggtgatagagtgccggctttgatcccccatcgaccgtttgggtccctcaccaagacatcagccctgagagcagattaattgatctgatactgttgaatcgttttctacccatag

SEQ ID NO: 119 - DNA, 83 bp, Mortierella alpina
  Intron (1)..(83)
  Intron (1)..(83)
gtaagagcatttttctatatcgacaagggtctctagtgagttggctacggaatggtcactaacgcatgcttttgccaatacag

SEQ ID NO: 120 - DNA, 99 bp, Mortierella alpina
  Intron (1)..(99)
  Intron (1)..(99)
gtatacttttttttttttttttttttttttttcgcctttgtgttttgtgctcgacctgtgaaaactaatttatttcttccttcgttctgccaccggtag

SEQ ID NO: 121 - DNA, 2133 bp, Yarrowia lipolytica
  misc_feature: CPT1
attctgttgctcttgttgccagctttcgtctggtatatttggatctcgatcttcatgtgtgatgactcagctggcaggaggtgaacaattttggagcggccaaatgcgccacactgaatgccgcaagaatcggatgagaaccgtagacatactggcatgtcaattgaaactgtgggtgtctactcgtgtactcttctgatatataattatcgattttcttcttccagactggaaatagctcagattcccaactgtccctccacctacctccctggttgtctcacaaggctgaaacttgaactgggccatctttatcaagtataaaacccattgtcaccttctctgtccccacagaccttccaacggcttctttttggccccgcaagttcatcctgaagccccccacccacctatcacgagaataagctttctggcaacaacccaaataaatttatttggcaagcgaaaaaagtaaaatcaaacttgaccattcaaccatcatgggcgtattcattaaacaggagcagcttccggctctcaagaagtacaagtgagtatggatgtggcgaagttggaagaacggtcacgtgagctcgacgagtggtgttgacgttcactttgacagtcctgaggtggagataatgacgtactaccaatagtgtaggggatgaggacgtgttggggttgtggcagcagatacatggtcataatatatggctgtctgttatctaagacaagtgccggatcgatcgcgtggatgtatatcctaatctacgccagtggttcatgctaacccaggtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaatcgagtcccgacacggtccaaaagacattatatatagacagaaataaatttatacattgactaacgagtgagtacagcagtgaatggcaagtcaccagccacaagacaagttcaagtaagtacaagaacagtgcgtatcagtagatgctgtacttgcaacgtgcttctctgtcaatctcagtctctcattttgtcttgtc

SEQ ID NO: 122 - DNA, 1185 bp, Yarrowia lipolytica
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 123 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 124 - DNA, 1434 bp, Saccharomyces cerevisiae
atgtacaacagaaaagacagagatgttcacgagaggaaggaagatggtcaatctgagtttgaagcactgaacgggaccaacgcaattatgtccgataatagtaaagcgtattccataaagtttctgaccttcaatacatgggggttaaaatacgtctccaaacaccgtaaagaaagactcagagcaattgctgataaattggcgggccactcaatgcttacgccaatatctgacgagttgttgcccaatggtggagatagtaatgaaaacgaagattacgacgtgattgccttacaagaaatctggtgtgtggaagactggaagtatctagcttctgcgtgtgcctccaagtatccgtatcagcgtttgttccattctggtattctgacggggcctgggttggccatactgtccaaggtcccgatagagtcgacctttctttaccggttcccgataaacggtagaccgagtgcggtgttccgtggcgactggtacgtagggaaatctatagcaatcaccgtattgaacacaggaacccgccccattgcaataatgaacagtcacatgcacgccccatacgccaagcagggtgatgccgcctacttgtgccacagatcttgtcaggcctgggatttcagcaggctcattaagctttacaggcaggccggttatgcggtgattgtggtgggtgacttaaactccagaccgggctcactgccccacaaatttctcacgcaggaggccggcctggtcgactcctgggagcaattgcatgggaagcaagacttggcggtgatcgctcgtctgtctccattgcaacaattgcttaagggctgtaccacgtgcgattcgctgctcaacacatggagggcccaaagacaacccgatgaggcatgcaggttggattatgctcttatcgaccctgatttcttgcaaacagtagacgcaggtgtcaggttcactgaacggatccctcacctggactgcagtgtctctgaccattttgcatactcatgcacccttaacatcgtcccacagggcacagagtcccgtccatccacctccgttaagcgtgcgaagactcatgatagagagctgatcttgcagagatactccaactacgaaaccatgatagaatgcatccacacgtacttgaagacagcccaaagacagaaatttttccgtggcctacatttctgggcctcaatacttctcctaatagcgtcgttggtcgtgacaacgtttactgcaaacaaggcaggctggtcctccatcttctgggtccttttcgctattgctgtctccatctcgggcaccatcgacggtgccatctccttcttgtttggcaggtctgaaatcagagccctcatcgaagtcgaacaagaggttctggacgcggagcaccacctgcaaactttcttgagcgagaaatga

SEQ ID NO: 125 - protein, 477 aa, Saccharomyces cerevisiae (GenBank Accession No. NP_010935)
MYNRKDRDVHERKEDGQSEFEALNGTNAIMSDNSKAYSIKFLTFNTWGLKYVSKHRKERLRAIADKLAGHSMLTPISDELLPNGGDSNENEDYDVIALQEIWCVEDWKYLASACASKYPYQRLFHSGILTGPGLAILSKVPIESTFLYRFPINGRPSAVFRGDWYVGKSIAITVLNTGTRPIAIMNSHMHAPYAKQGDAAYLCHRSCQAWDFSRLIKLYRQAGYAVIVVGDLNSRPGSLPHKFLTQEAGLVDSWEQLHGKQDLAVIARLSPLQQLLKGCTTCDSLLNTWRAQRQPDEACRLDYALIDPDFLQTVDAGVRFTERIPHLDCSVSDHFAYSCTLNIVPQGTESRPSTSVKRAKTHDRELILQRYSNYETMIECIHTYLKTAQRQKFFRGLHFWASILLLIASLVVTTFTANKAGWSSIFWVLFAIAVSISGTIDGAISFLFGRSEIRALIEVEQEVLDAEHHLQTFLSEK

SEQ ID NO: 126 - DNA, 8953 bp, Artificial Sequence
  Plasmid pY5-30
ggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgtcgactcaggcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgattaattaactagagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgc

SEQ ID NO: 127 - DNA, 36 bp, Artificial Sequence
  Primer 506
gtagttgtgccgaggcactgtgggaaagagatgatg

SEQ ID NO: 128 - DNA, 12649 bp, Artificial Sequence
  Plasmid pKUNF12T6E
  misc_feature (2507)..(2507): n is a, c, g, or t
  misc_feature (2512)..(2515): n is a, c, g, or t
taaccctcactaaagggaacaaaagctggagctccaccgcggacacaatatctggtcaaatttcagtttcgttacataaatcgttatgtcaaaggagtgtgggaggttaagagaattatcaccggcaaactatctgttaattgctaggtacctctagacgtccacccgggtcgcttggcggccgaagaggccggaatctcgggccgcggtggcggccgcttagttggtcttggacttcttgggcttcttcaggtaggactggacaaagaagttgccgaacagagcgagcagggtgatcatgtacacgccgagcagctggaccagagcctgagggtagtcgcaggggaagaggtagtcgtacagggactgcaccagcatagccatgaactgggtcatctgcagagtggtgatgtagggcttgatgggcttgacgaagccgaagccctgagaggaaaagaagtagtaggcgtacatgacggtgtggacgaaggagttgaggatgacggagaagtaggcgtcgccaccaggagcgtacttggcaatagcccaccagatggcgaagatggtggcatggtggtacacgtgcaggaaggagacctggttgaacttcttgcacaggatcatgatagcggtgtccaggaactcgtaggccttggagacgtagaacacgtagacgattcgggacatgccctgagcgtgggactcgttgcccttctccatgtcgttgccgaagaccttgtagccacccaggatagcctgtcggatggtctcgacgcacatgtagagggacagtccgaagaggaacaggttgtggagcagcttgatggtcttcagctcgaagggcttctccatctgcttcatgatgggaatgccgaagagcagcatggccatgtagccgacctcgaaggcgagcatggtggagacgtccatcatgggcagaccgtcggtcagagcgtagggcttagctccgtccatccactggtcgacaccggtctcgactcgtccgaccacgtcgtcccagacagaggagttggccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattctgcatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcgcctacttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccnacgannnnctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattgttcctctatagtactgcgtacactgtttaaacagtgtacgcagatctgcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggagtccattgctcccttcctgccctccaagatgcctcaggacctgttcatggacctcgccagcgctatcggtgtccgagctgctccctacgtcgatcccctggaggctgccctggttgcccaggccgagaagtacattcccaccattgtccatcacactcgaggcttcctggttgccgtggagtctcccctggctcgagagctgcctctgatgaaccccttccacgtgctcctgatcgtgctcgcctacctggtcaccgtgtttgtgggtatgcagatcatgaagaactttgaacgattcgaggtcaagaccttctccctcctgcacaacttctgtctggtctccatctccgcctacatgtgcggtggcatcctgtacgaggcttatcaggccaactatggactgtttgagaacgctgccgatcacaccttcaagggtctccctatggctaagatgatctggctcttctacttctccaagatcatggagtttgtcgacaccatgatcatggtcctcaagaagaacaaccgacagatttcctttctgcacgtgtaccaccactcttccatcttcaccatctggtggctggtcaccttcgttgctcccaacggtgaagcctacttctctgctgccctgaactccttcatccacgtcatcatgtacggctactactttctgtctgccctgggcttcaagcaggtgtcgttcatcaagttctacatcactcgatcccagatgacccagttctgcatgatgtctgtccagtcttcctgggacatgtacgccatgaaggtccttggccgacctggataccccttcttcatcaccgctctgctctggttctacatgtggaccatgctcggtctcttctacaacttttaccgaaagaacgccaagctcgccaagcaggccaaggctgacgctgccaaggagaaggccagaaagctccagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaat

SEQ ID NO: 129 - DNA, 10945 bp, Artificial Sequence
  Plasmid pDMW232
aattcctgcagcccatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcagctaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcagctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtag

SEQ ID NO: 130 - DNA, 12690 bp, Artificial Sequence
  Plasmid pZP3L37
aaataccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttagatctgtatattcggtaagatatattttgtggggttttagtggtgtttaaacagtgtacgcagtactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacggtgtgtatcgtagaggtagtgacgtgttgtccacagggcgactgtgtccgtgtatatatatattcctcggcccgagcttatttgtgtggggttgaggaaatcaaaccaaatcggtagtcagagaaataaaacaaaaagaaataaaaagaaatagaggacgcacaacgccatcaccgtcggagagacaggagaagggaaaatgggcaaaaatgcccttatcacacccgcccgctttgtgctctcattcggctcccacaagagcctcttgtcctggttccccccccccacattttaacaccccacacgacgttgctgcacgtggaattttcggccgaaaacctgtggggtacttacttttggcactggagagaagcatctgggattttgggaacctaggcagaagatgaggaaaaaaataagaggaaccgttgtgagcttgcttatcagtgtcatatactcccccctccttgcgtttttgcgtcttttccccctatttttcaaattttgcgattttttttctctttttttccgcttttttccgctttttttttggccggcttttatccatttctccaagccgaggatcacatctatgcagcccagtccgttggagcatatctgcggtagagtttcggaacggcgttaagcactgtgtccgggtcggtctggaacgagattgagcgggaaattcgggggaataagaccaccgttggactccccgcaatgaggagatcaagatgtgcttttcagaattctgattggtggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgtcgagatatcgacattgttccatctccagtttaaccccaacttatcgagagtatttgtgagacacgcaataaatgaatttataccaatcaaatccatattctacgctgtctacatatagatactttttgtcatctcttgccctactatttcgtcgatatatgaaggatacgccaaccgaacccatactccacgctacacacgcgccttttcacgcatttctggggaaaatagacacccttggtgtcacctgaagaatatgaaagaagatattcattgtattgagctgtagatctgtgtatttcttgacctcatcaatgacttctgggctctttacctcgaatcatggtggtactgtaccacatctcaacaccttgtagcacacctatgggaaaattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatctattcctcgtccagctcgcaaatgtcgtcatcttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagtcgctcttggccttggctgcagcggcagactctttgagggtgaaaatctgagcagtctcgggcacagctccgtagttgacaaagaggtgagcggtcttgaagaaggcagtaatgatgggctcgtcgttacgtctcacgaggtgagggtaagcggcagcaaagtgcttggtggcttcgttgagcttgtagtggggaatgatagggaacaagtgatggacctggtgggtgccaatgtggtgagacaggttgtccacgaaagctccgtacgatcggtcgacggagctcaggttgcccttgacgtaggtccactccgagtcaccgtaccagggagtagcttcgtcgttgtgatgcaagaaggtagtaatgacgaggaacgaagcaaagacaaagagaggagcatagtagtagaggcccatgacggcaaagccgagcgagtatgtgaggtaggcgtaggcagcgaagaaggcagcccagactccgagggacacgatgacagcggaggctcgtcgaagcaggagagggtcccaggggtcaaagtgggacatggttcgaggagcatatccgaccttcaggtagacaaaccaagcacctccgagggtgtagacccattgtcgcacgtcctggaggtccttgacggaccgatgagggtagaagatctcgtccttatcaatgttgccagtgttcttgtgatggtgtcggtgggtcactcgccaggactcgaagggagtcagaatggcagagtgcatgatgcagccaatgatgaagttgacggagtggtatcgggagaaggcagagtgaccacagtcgtgaccgacggtaaagaaaccccagaagatgacaccctgcacgtagatgtaggtggcgcaaaccagagcgtggagcagaacgttatcggcaatgaagggagtagatcgggcagcgtagagcagagcagcagaggcagatgcgttgaagatcgctcgggcagtgtagtagagcgagagtccgaggttggactcaaagcaagcgttagggatagagtgcttcagctcagtcagggtagggaactcgaccttggtcttatcctcagccatggtaccagagctgggttagtttgtgtagagagtgtgtgttgctagcgactttcggattgtgtcattacacaaaacgcgtcgtctcgacactgatcttgtcgtggatactcacggctcggaattctgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattt

SEQ ID NO: 131 - DNA, 8194 bp, Artificial Sequence
  Plasmid pY37/F15
ggccgcacaatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggctaggcggccgccaccgcggcccgaattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaatccgc

SEQ ID NO: 132 - DNA, 10838 bp, Artificial Sequence
  Plasmid pKO2UF2PE
  misc_feature (1615)..(1618): n is a, c, g, or t
  misc_feature (1623)..(1623): n is a, c, g, or t
aaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgagnnnntcgtnggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaagtaggcgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggtgaagcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattccgtcgtcgcctgagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttactggagctttctggccttctccttggcagcgtcagccttggcctgcttggcgagcttggcgttctttcggtaaaagttgtagaagagaccgagcatggtccacatgtagaaccagagcagagcggtgatgaagaaggggtatccaggtcggccaaggaccttcatggcgtacatgtcccaggaagactggacagacatcatgcagaactgggtcatctgggatcgagtgatgtagaacttgatgaacgacacctgcttgaagcccagggcagacagaaagtagtagccgtacatgatgacgtggatgaaggagttcagggcagcagagaagtaggcttcaccgttgggagcaacgaaggtgaccagccaccagatggtgaagatggaagagtggtggtacacgtgcagaaaggaaatctgtcggttgttcttcttgaggaccatgatcatggtgtcgacaaactccatgatcttggagaagtagaagagccagatcatcttagccatagggagacccttgaaggtgtgatcggcagcgttctcaaacagtccatagttggcctgataagcctcgtacaggatgccaccgcacatgtaggcggagatggagaccagacagaagttgtgcaggagggagaaggtcttgacctcgaatcgttcaaagttcttcatgatctgcatacccacaaacacggtgaccaggtaggcgagcacgatcaggagcacgtggaaggggttcatcagaggcagctctcgagccaggggagactccacggcaaccaggaagcctcgagtgtgatggacaatggtgggaatgtacttctcggcctgggcaaccagggcagcctccaggggatcgacgtagggagcagctcggacaccgatagcgctggcgaggtccatgaacaggtcctgaggcatcttggagggcaggaagggagcaatggactccatggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggacagtcagaggagtacacgctgcttacataatggcgcaacgaccacatgtcccacagatacgcattatgcctgtacatattccgggggaggtatgtaccagtagttcgcctgctaccgttagctacattt

SEQ ID NO: 133 - DNA, 5833 bp, Artificial Sequence
  Plasmid pZKUT16
gtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacatgtccgtcctgactctccaagagtacgagttcgagaagcagttcaacgagaatgaagccatccaatggatgcaggaaaactggaagaaatccttcctgttttctgccctctacgctgcctttatctttggtggacgacatctgatgaacaagcgagccaagtttgagctgcgaaaacctctcgtgctctggtccctgaccctcgctgtcttctctatcttcggtgctctgcgaactggagcctacatgctctacatcctgatgaccaaaggcctgaaacagtctgtttgtgaccagtccttttacaacggacccgtctcgaaattctgggcttacgcctttgtgctctccaaagctcccgaacttggcgataccatcttcatcattctgcgaaagcagaaactcatcttcctgcactggtatcaccacatcaccgtcctcctgtactcttggtactcctacaaggacatggtggctggaggtggctggttcatgactatgaactacggtgtccacgccgtgatgtactcctactacgccctccgagctgccggtttccgagtctctcgaaagtttgccatgttcatcaccctgtcgcagatcactcagatgctcatgggctgtgtcattaactacctggtcttcaactggatgcagcatgacaatgaccagtgctactcccactttcagaacatcttctggtcctctctcatgtacctctcctaccttctgctcttctgccatttcttctttgaggcctacattggcaaagtgaagaaagccaccaaggctgagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 134 - DNA, 12663 bp, Artificial Sequence
  Plasmid pKO2UM25E
agcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcacctcccaacactatcgacgctggcttgacccagcgtcatatcaccaccacggccgccccaacctcggccaagcccgctttcgagcgcaactaccagctccccgagttcaccatcaaggagatccgagagtgcatccctgcccactgctttgagcgctccggtcttcgtggtctctgccacgttgccattgatctgacctgggcctcgctcttgttcctggctgcaacccagatcgacaagttcgagaaccccttgatccgctatctggcctggcctgcgtactggatcatgcagggcattgtctgcaccggcatatgggtgctggcccacgagtgcggtcaccagtccttctcgacctccaagactctcaacaacaccgtcggctggatcctgcactcgatgctcttggtcccctaccactcctggagaatctcgcactcgaagcaccacaaggccactggccacatgaccaaggaccaggtctttgttcccaagacccgctcccaggttggtttgcctcccaaggagagcgctgctgctgccgttcaagaggaggacatgtccgtgcacctggatgaggaggcccctattgtgactttgttctggatggtgatccagttcctgttcggatggcctgcatacctgatcatgaacgcctctggtcaggactatggccgctggacctcgcacttccacacttactcgcccatctttgagccccgcaacttcttcgacattatcatctcggatctcggtgtgttggctgccctcggtgccctgatctacgcttccatgcagctgtcgctcttgaccgtgaccaagtactacatcatcccgtacctgtttgtcaacttttggttggtcctgattactttcttgcagcacaccgaccccaagctgccccattaccgtgagggtgcctggaacttccagcgtggagccctctgcaccgttgaccgctcgtttggcaagttcttggaccatatgttccacggcatcgtccatacccatgtggcccatcacttgttctcgcagatgccgttctaccatgctgaagaagctacctaccatctcaagaaactgctgggagagtactacgtttacgacccatccccgatcgtcgttgcggtctggaggtcgttccgcgagtgccgattcgtggaggatcagggagacgtggtctttttcaagaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagatcgtcaagggtttgtggccaactggtatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggagtccattgctcccttcctgccctccaagatgcctcaggacctgttcatggacctcgccagcgctatcggtgtccgagctgctccctacgtcgatcccctggaggctgccctggttgcccaggccgagaagtacattcccaccattgtccatcacactcgaggcttcctggttgccgtggagtctcccctggctcgagagctgcctctgatgaaccccttccacgtgctcctgatcgtgctcgcctacctggtcaccgtgtttgtgggtatgcagatcatgaagaactttgaacgattcgaggtcaagaccttctccctcctgcacaacttctgtctggtctccatctccgcctacatgtgcggtggcatcctgtacgaggcttatcaggccaactatggactgtttgagaacgctgccgatcacaccttcaagggtctccctatggctaagatgatctggctcttctacttctccaagatcatggagtttgtcgacaccatgatcatggtcctcaagaagaacaaccgacagatttcctttctgcacgtgtaccaccactcttccatcttcaccatctggtggctggtcaccttcgttgctcccaacggtgaagcctacttctctgctgccctgaactccttcatccacgtcatcatgtacggctactactttctgtctgccctgggcttcaagcaggtgtcgttcatcaagttctacatcactcgatcccagatgacccagttctgcatgatgtctgtccagtcttcctgggacatgtacgccatgaaggtccttggccgacctggataccccttcttcatcaccgctctgctctggttctacatgtggaccatgctcggtctcttctacaacttttaccgaaagaacgccaagctcgccaagcaggccaaggctgacgctgccaaggagaaggccagaaagctccagtaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctcca

SEQ ID NO: 135 - DNA, 14864 bp, Artificial Sequence
  Plasmid pDMW302T16
  misc_feature (5341)..(5341): n is a, c, g, or t
  misc_feature (5346)..(5349): n is a, c, g, or t
gtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcgcctacttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccnacgannnnctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttactggagctttctggccttctccttggcagcgtcagccttggcctgcttggcgagcttggcgttctttcggtaaaagttgtagaagagaccgagcatggtccacatgtagaaccagagcagagcggtgatgaagaaggggtatccaggtcggccaaggaccttcatggcgtacatgtcccaggaagactggacagacatcatgcagaactgggtcatctgggatcgagtgatgtagaacttgatgaacgacacctgcttgaagcccagggcagacagaaagtagtagccgtacatgatgacgtggatgaaggagttcagggcagcagagaagtaggcttcaccgttgggagcaacgaaggtgaccagccaccagatggtgaagatggaagagtggtggtacacgtgcagaaaggaaatctgtcggttgttcttcttgaggaccatgatcatggtgtcgacaaactccatgatcttggagaagtagaagagccagatcatcttagccatagggagacccttgaaggtgtgatcggcagcgttctcaaacagtccatagttggcctgataagcctcgtacaggatgccaccgcacatgtaggcggagatggagaccagacagaagttgtgcaggagggagaaggtcttgacctcgaatcgttcaaagttcttcatgatctgcatacccacaaacacggtgaccaggtaggcgagcacgatcaggagcacgtggaaggggttcatcagaggcagctctcgagccaggggagactccacggcaaccaggaagcctcgagtgtgatggacaatggtgggaatgtacttctcggcctgggcaaccagggcagcctccaggggatcgacgtagggagcagctcggacaccgatagcgctggcgaggtccatgaacaggtcctgaggcatcttggagggcaggaagggagcaatggactccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacatgtccgtcctgactctccaagagtacgagttcgagaagcagttcaacgagaatgaagccatccaatggatgcaggaaaactggaagaaatccttcctgttttctgccctctacgctgcctttatctttggtggacgacatctgatgaacaagcgagccaagtttgagctgcgaaaacctctcgtgctctggtccctgaccctcgctgtcttctctatcttcggtgctctgcgaactggagcctacatgctctacatcctgatgaccaaaggcctgaaacagtctgtttgtgaccagtccttttacaacggacccgtctcgaaattctgggcttacgcctttgtgctctccaaagctcccgaacttggcgataccatcttcatcattctgcgaaagcagaaactcatcttcctgcactggtatcaccacatcaccgtcctcctgtactcttggtactcctacaaggacatggtggctggaggtggctggttcatgactatgaactacggtgtccacgccgtgatgtactcctactacgccctccgagctgccggtttccgagtctctcgaaagtttgccatgttcatcaccctgtcgcagatcactcagatgctcatgggctgtgtcattaactacctggtcttcaactggatgcagcatgacaatgaccagtgctactcccactttcagaacatcttctggtcctctctcatgtacctctcctaccttctgctcttctgccatttcttctttgaggcctacattggcaaagtgaagaaagccaccaaggctgagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 136 - DNA, 15996 bp, Artificial Sequence
  Plasmid pDMW303
  misc_feature (5344)..(5344): n is a, c, g, or t
  misc_feature (5349)..(5352): n is a, c, g, or t
gtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgcttatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcagcggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatggccactgccgatgcggtgcgaacatccctggagggattctcggagctctacacaatgcagattctgtcgtcgagtactctctaccttgctcggatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcgcctacttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccnacgannnnctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcttactggagctttctggccttctccttggcagcgtcagccttggcctgcttggcgagcttggcgttctttcggtaaaagttgtagaagagaccgagcatggtccacatgtagaaccagagcagagcggtgatgaagaaggggtatccaggtcggccaaggaccttcatggcgtacatgtcccaggaagactggacagacatcatgcagaactgggtcatctgggatcgagtgatgtagaacttgatgaacgacacctgcttgaagcccagggcagacagaaagtagtagccgtacatgatgacgtggatgaaggagttcagggcagcagagaagtaggcttcaccgttgggagcaacgaaggtgaccagccaccagatggtgaagatggaagagtggtggtacacgtgcagaaaggaaatctgtcggttgttcttcttgaggaccatgatcatggtgtcgacaaactccatgatcttggagaagtagaagagccagatcatcttagccatagggagacccttgaaggtgtgatcggcagcgttctcaaacagtccatagttggcctgataagcctcgtacaggatgccaccgcacatgtaggcggagatggagaccagacagaagttgtgcaggagggagaaggtcttgacctcgaatcgttcaaagttcttcatgatctgcatacccacaaacacggtgaccaggtaggcgagcacgatcaggagcacgtggaaggggttcatcagaggcagctctcgagccaggggagactccacggcaaccaggaagcctcgagtgtgatggacaatggtgggaatgtacttctcggcctgggcaaccagggcagcctccaggggatcgacgtagggagcagctcggacaccgatagcgctggcgaggtccatgaacaggtcctgaggcatcttggagggcaggaagggagcaatggactccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggatggctcccgaccctgtcgctgccgagaccgctgcccagggtcccactccccgatacttcacctgggacgaggtcgcccagcgatccggttgcgaggaacgatggctggtcatcgaccgaaaggtgtacaacatctctgagttcacccgacgacatcccggtggctcccgagtgatctcgcactacgctggacaggacgccactgaccccttcgttgcctttcacattaacaagggcctggttaagaagtacatgaactccctgctcattggagagctgtctcccgaacagccttcgtttgagcctaccaagaacaaggagctgaccgacgagtttcgagagctccgagccaccgttgagcgaatgggactgatgaaggccaaccatgtcttctttctgctctacctgctccacattcttctccttgacggagctgcctggcttaccctgtgggtcttcggcacttcctttctgccctttcttctctgcgccgtcctgctctctgccgtgcaggctcaggctggttggcttcagcatgactttggtcacctttccgtgttctctacctccaagtggaaccacctgctccatcacttcgtgatcggccacctcaagggtgctcctgcctcgtggtggaaccacatgcatttccagcaccatgccaagcccaactgttttcgaaaggatcccgacatcaacatgcaccccttctttttcgctcttggcaagatcctgtccgtcgagctcggaaagcagaagaagaagtacatgccctacaaccaccagcacaagtacttcttcctgattggacctcccgctctcctgcctctttactttcagtggtacatcttttactttgttattcagcgaaagaagtgggttgatcttgcctggatgatcaccttctacgtccgattcttcctgacctacgtccctctccttggactgaaggcctttctcggtctgttctttatcgtccgattcctggagtccaactggttcgtgtgggtgacccagatgaaccacattcccatgcacattgaccatgatcgaaacatggactgggtgtcgactcagctgcaggccacctgcaacgttcacaagtctgctttcaacgactggttttccggtcacctcaactttcagattgagcaccatctgtttcccaccatgcctcgacacaactaccacaaggttgctcccctggtccagtcgctctgtgccaagcatggcatcgagtaccagtccaagcccctgctctctgccttcgctgacatcattcactcgctgaaggaatctggccagctctggctcgatgcctacctgcaccagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 137 - DNA, 13034 bp, Artificial Sequence
  Plasmid pDMW271
cgatgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggatggctcccgaccctgtcgctgccgagaccgctgcccagggtcccactccccgatacttcacctgggacgaggtcgcccagcgatccggttgcgaggaacgatggctggtcatcgaccgaaaggtgtacaacatctctgagttcacccgacgacatcccggtggctcccgagtgatctcgcactacgctggacaggacgccactgaccccttcgttgcctttcacattaacaagggcctggttaagaagtacatgaactccctgctcattggagagctgtctcccgaacagccttcgtttgagcctaccaagaacaaggagctgaccgacgagtttcgagagctccgagccaccgttgagcgaatgggactgatgaaggccaaccatgtcttctttctgctctacctgctccacattcttctccttgacggagctgcctggcttaccctgtgggtcttcggcacttcctttctgccctttcttctctgcgccgtcctgctctctgccgtgcaggctcaggctggttggcttcagcatgactttggtcacctttccgtgttctctacctccaagtggaaccacctgctccatcacttcgtgatcggccacctcaagggtgctcctgcctcgtggtggaaccacatgcatttccagcaccatgccaagcccaactgttttcgaaaggatcccgacatcaacatgcaccccttctttttcgctcttggcaagatcctgtccgtcgagctcggaaagcagaagaagaagtacatgccctacaaccaccagcacaagtacttcttcctgattggacctcccgctctcctgcctctttactttcagtggtacatcttttactttgttattcagcgaaagaagtgggttgatcttgcctggatgatcaccttctacgtccgattcttcctgacctacgtccctctccttggactgaaggcctttctcggtctgttctttatcgtccgattcctggagtccaactggttcgtgtgggtgacccagatgaaccacattcccatgcacattgaccatgatcgaaacatggactgggtgtcgactcagctgcaggccacctgcaacgttcacaagtctgctttcaacgactggttttccggtcacctcaactttcagattgagcaccatctgtttcccaccatgcctcgacacaactaccacaaggttgctcccctggtccagtcgctctgtgccaagcatggcatcgagtaccagtccaagcccctgctctctgccttcgctgacatcattcactcgctgaaggaatctggccagctctggctcgatgcctacctgcaccagtaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgcccactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttagctgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttagctgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgatcgatgggctgcaggaattctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccagatctgcgtacactgtttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcat

SEQ ID NO: 138 - DNA, 6912 bp, Artificial Sequence
  Plasmid pZKUGPI5S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaagc

SEQ ID NO: 139 - DNA, 6540 bp, Artificial Sequence
  Plasmid pZKUGPE1S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggagtccattgctcccttcctgccctccaagatgcctcaggacctgttcatggacctcgccagcgctatcggtgtccgagctgctccctacgtcgatcccctggaggctgccctggttgcccaggccgagaagtacattcccaccattgtccatcacactcgaggcttcctggttgccgtggagtctcccctggctcgagagctgcctctgatgaaccccttccacgtgctcctgatcgtgctcgcctacctggtcaccgtgtttgtgggtatgcagatcatgaagaactttgaacgattcgaggtcaagaccttctccctcctgcacaacttctgtctggtctccatctccgcctacatgtgcggtggcatcctgtacgaggcttatcaggccaactatggactgtttgagaacgctgccgatcacaccttcaagggtctccctatggctaagatgatctggctcttctacttctccaagatcatggagtttgtcgacaccatgatcatggtcctcaagaagaacaaccgacagatttcctttctgcacgtgtaccaccactcttccatcttcaccatctggtggctggtcaccttcgttgctcccaacggtgaagcctacttctctgctgccctgaactccttcatccacgtcatcatgtacggctactactttctgtctgccctgggcttcaagcaggtgtcgttcatcaagttctacatcactcgatcccagatgacccagttctgcatgatgtctgtccagtcttcctgggacatgtacgccatgaaggtccttggccgacctggataccccttcttcatcaccgctctgctctggttctacatgtggaccatgctcggtctcttctacaacttttaccgaaagaacgccaagctcgccaagcaggccaaggctgacgctgccaaggagaaggccagaaagctccagtaagc

SEQ ID NO: 140 - DNA, 13321 bp, Artificial Sequence
  Plasmid pKO2UM26E
tgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttgaatctacaagtaggagggttggagtgattaagtgaaacttctttaacggctctatgccagttctattgatatccgaaacatcagtatgaaggtctgataagggtgacttcttcccacagattcgtatcagtacgagtacgagaccggtacttgtaacagtattgatactaaagggaaactacaacggttgtcagcgtaatgtgacttcgcccatgaacgcagacacgcagtgccgagtgcggtgatatcgcctactcgttacgtccatggactacacaacccctcggcttcgcttggcttagcctcgggctcggtgctgttcagttaaaacacaatcaaataacatttctactttttagaaggcaggccgtcaggagcaactccgactccattgacgtttctaaacatctgaatgccttccttaccttcaacaaactggcaggttcgggcgacagtgtaaagagacttgatgaagttggtgtcgtcgtgtcggtagtgcttgcccatgaccttcttgatcttctcagtggcgattcgggcgttgtagaagggaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctacctctgacccttccgtccgagctttcacacgatctgaagtcttgcacgccgatgccttgaacgagggcaaaaagaatgctgaagccccgttcctcatgatcattgacaacaaagtctacgatgtgcgcgagtttgtccccgaccatcctggcggtagtgtcattttgacccacgtaggcaaggacggcacggacgtcttcgagaccttccatcccgaggccgcgtgggaaacgctcgccaacttttatgtcggcgacattgcagaatccgatcgtgcgattgagaatgacgagtttgcagccgaagtccgcaagctgcgtactttgttccagtctctgggatattacaactcatccaaaacctactacgccttcaaggtctcattcaacctctgcatctggggcctgtcggcgtttatggttgccaagtggggccagacctcgaccctcgccaacgtggtgtctgcgtcgcttctgggtgtcttttggcaacagtgtggttggctcgcccatgacttcttacaccaccaggtctttcacgatcggttctggggtgatttgtttggtgccttcctcggcggagtctgtcaggggttctcctcttcctggtggaaggacaaacacaacacccaccacgcggcgcccaatgtccacggagaggatcccgatatcgacacgcacccactgttgacatggagcgaacatgcgctcgagatgttttcggatgtgcccgatgaggagttggcccaaatgtggtcccggtttatggttgtgaaccagacctggttttactttcccattctgtcgttcgcccggttgtcgtggtgcattcagtccattctttttgtgctcccgaacggacaggcacacaagcctgcgggagcccgggtccccatctcgctggtggagcaattgtcgctggcgatgcattggacctggtatctggcgaccatgttcttgtttatcaaggatcctgtcaacataatggtgtatttcttggtctcgcaagcggtctgtggcaacctgttggcgattgtgttctctctgaaccataacggaatgcctgtgatctctcaggaagaagcggtcgagatggatttctttacaaagcagatcattacgggccgtgatgtccacccaggctggttcgcagactggttcacgggcggattgaactatcaaattgagcaccacctgttcccgtcgatgcctcgccactatttctcaaagatccaaccaacggtcgaatcattgtgcaaaaagtacggggtccgatatcacacgacggggatgatagatggcaccgcagaggtcttttcgcgactgaacgaggtctctcaggctgcctccaagctcggcaagtctgcttgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcacctcccaacactatcgacgctggcttgacccagcgtcatatcaccaccacggccgccccaacctcggccaagcccgctttcgagcgcaactaccagctccccgagttcaccatcaaggagatccgagagtgcatccctgcccactgctttgagcgctccggtcttcgtggtctctgccacgttgccattgatctgacctgggcctcgctcttgttcctggctgcaacccagatcgacaagttcgagaaccccttgatccgctatctggcctggcctgcgtactggatcatgcagggcattgtctgcaccggcatatgggtgctggcccacgagtgcggtcaccagtccttctcgacctccaagactctcaacaacaccgtcggctggatcctgcactcgatgctcttggtcccctaccactcctggagaatctcgcactcgaagcaccacaaggccactggccacatgaccaaggaccaggtctttgttcccaagacccgctcccaggttggtttgcctcccaaggagagcgctgctgctgccgttcaagaggaggacatgtccgtgcacctggatgaggaggcccctattgtgactttgttctggatggtgatccagttcctgttcggatggcctgcatacctgatcatgaacgcctctggtcaggactatggccgctggacctcgcacttccacacttactcgcccatctttgagccccgcaacttcttcgacattatcatctcggatctcggtgtgttggctgccctcggtgccctgatctacgcttccatgcagctgtcgctcttgaccgtgaccaagtactacatcatcccgtacctgtttgtcaacttttggttggtcctgattactttcttgcagcacaccgaccccaagctgccccattaccgtgagggtgcctggaacttccagcgtggagccctctgcaccgttgaccgctcgtttggcaagttcttggaccatatgttccacggcatcgtccatacccatgtggcccatcacttgttctcgcagatgccgttctaccatgctgaagaagctacctaccatctcaagaaactgctgggagagtactacgtttacgacccatccccgatcgtcgttgcggtctggaggtcgttccgcgagtgccgattcgtggaggatcagggagacgtggtctttttcaagaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagatcgtcaagggtttgtggccaactggtatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggagtccattgctcccttcctgccctccaagatgcctcaggacctgttcatggacctcgccagcgctatcggtgtccgagctgctccctacgtcgatcccctggaggctgccctggttgcccaggccgagaagtacattcccaccattgtccatcacactcgaggcttcctggttgccgtggagtctcccctggctcgagagctgcctctgatgaaccccttccacgtgctcctgatcgtgctcgcctacctggtcaccgtgtttgtgggtatgcagatcatgaagaactttgaacgattcgaggtcaagaccttctccctcctgcacaacttctgtctggtctccatctccgcctacatgtgcggtggcatcctgtacgaggcttatcaggccaactatggactgtttgagaacgctgccgatcacaccttcaagggtctccctatggctaagatgatctggctcttctacttctccaagatcatggagtttgtcgacaccatgatcatggtcctcaagaagaacaaccgacagatttcctttctgcacgtgtaccaccactcttccatcttcaccatctggtggctggtcaccttcgttgctcccaacggtgaagcctacttctctgctgccctgaactccttcatccacgtcatcatgtacggctactactttctgtctgccctgggcttcaagcaggtgtcgttcatcaagttctacatcactcgatcccagatgacccagttctgcatgatgtctgtccagtcttcctgggacatgtacgccatgaaggtccttggccgacctggataccccttcttcatcaccgctctgctctggttctacatgtggaccatgctcggtctcttctacaacttttaccgaaagaacgccaagctcgccaagcaggccaaggctgacgctgccaaggagaaggccagaaagctccagtaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccaagcttccactggtcggcgtggtagtggggcagagtggggtcggtgtgctgcaggtaggtgatggccacgagccagtggttgacccacaggtaggggatcaggtagtagagggtgacggaagccaggccccatcggttgatggagtatgcgatgacggacatggtgataccaataccgacgttagagatccagatgttgaaccagtccttcttctcaaacagcggggcgttggggttgaagtggttgacagcccatttgttgagcttggggtacttctgtccggtaacgtaagacagcagatacagaggccatccaaacacctgctgggtgatgaggccgtagagggtcatgaggggagcgtcctcagcaagctcagaccagtcatgggcgcctcggttctccataaactcctttcggtccttgggcacaaacaccatatcacgggtgaggtgaccagtggacttgtggtgcatggagtgggtcagcttccaggcgtagtaagggaccagcatggaggagtgcagaacccatccggtgacgttgttgacggtgttagagtcggagaaagcagagtggccacactcgtgggcaagaacccacagaccggtgccaaacagaccctggacaatggagtacatggcccaggccacagctcggccggaagccgagggaataagaggcaggtacgcgtaggccatgtaggcaaaaacggcgataaagaagcaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttc

SEQ ID NO: 141 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 142 - DNA, 6457 bp, Artificial Sequence
  Plasmid pKUNT2
tttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacaccactaaaaccccacaaaatatatcttaccgaatatacagatctgcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggattcgaccacgcagaccaacaccggcaccggcaaggtggccgtgcagccccccacggccttcattaagcccattgagaaggtgtccgagcccgtctacgacacctttggcaacgagttcactcctccagactactctatcaaggatattctggatgccattccccaggagtgctacaagcggtcctacgttaagtcctactcgtacgtggcccgagactgcttctttatcgccgtttttgcctacatggcctacgcgtacctgcctcttattccctcggcttccggccgagctgtggcctgggccatgtactccattgtccagggtctgtttggcaccggtctgtgggttcttgcccacgagtgtggccactctgctttctccgactctaacaccgtcaacaacgtcaccggatgggttctgcactcctccatgctggtcccttactacgcctggaagctgacccactccatgcaccacaagtccactggtcacctcacccgtgatatggtgtttgtgcccaaggaccgaaaggagtttatggagaaccgaggcgcccatgactggtctgagcttgctgaggacgctcccctcatgaccctctacggcctcatcacccagcaggtgtttggatggcctctgtatctgctgtcttacgttaccggacagaagtaccccaagctcaacaaatgggctgtcaaccacttcaaccccaacgccccgctgtttgagaagaaggactggttcaacatctggatctctaacgtcggtattggtatcaccatgtccgtcatcgcatactccatcaaccgatggggcctggcttccgtcaccctctactacctgatcccctacctgtgggtcaaccactggctcgtggccatcacctacctgcagcacaccgaccccactctgccccactaccacgccgaccagtggaacttcacccgaggagccgccgccaccatcgaccgagagtttggcttcatcggctccttctgcttccatgacatcatcgagacccacgttctgcaccactacgtgtctcgaattcccttctacaacgcccgaatcgccactgagaagatcaagaaggtcatgggcaagcactaccgacacgacgacaccaacttcatcaagtctctttacactgtcgcccgaacctgccagtttgttgaaggtaaggaaggcattcagatgtttagaaacgtcaatggagtcggagttgctcctgacggcctgccttctaaaaagtaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaattaa

SEQ ID NO: 143 - DNA, 8165 bp, Artificial Sequence
  Plasmid pZUF17
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 144 - DNA, 7879 bp, Artificial Sequence
  Plasmid pDMW237
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagc

SEQ ID NO: 145 - DNA, 8502 bp, Artificial Sequence
  Plasmid pY54PC
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcctgcagcccatcgatgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctacctccaagatgggtaaggcgcagtaagc

SEQ ID NO: 146 - DNA, 7145 bp, Artificial Sequence
  Plasmid pKUNFmkF2
  misc_feature (692)..(695): n is a, c, g, or t
  misc_feature (700)..(700): n is a, c, g, or t
catggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgagnnnntcgtnggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaagtaggcgcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgatcgatggtcatagctgtttcctgtgtgaaattgttatccgctcacaattccacacaacgtacgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaattaatttgaatcgaatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 147 - DNA, 5553 bp, Artificial Sequence
  Plasmid pZF5T-PPC
ggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgtttaaacagtgtacgcagtactatagaggaacatcgattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcagctaagc

SEQ ID NO: 148 - DNA, 10448 bp, Artificial Sequence
  Plasmid pDMW297
cgattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgcaggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaat

SEQ ID NO: 149 - DNA, 15543 bp, Artificial Sequence
  Plasmid pZP2C16M899
catggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggacagtcagaggagtacgtacgctgcttacataatggcgcaacgaccacatgtcccacagatacgcatcgattccggttccgggtacaccgtgggcgttggtgatatcaccaacgcccacggtgtacccggaaccggaatcgataacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaacaatggctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggacatgtccgtcctgactctccaagagtacgagttcgagaagcagttcaacgagaatgaagccatccaatggatgcaggaaaactggaagaaatccttcctgttttctgccctctacgctgcctttatctttggtggacgacatctgatgaacaagcgagccaagtttgagctgcgaaaacctctcgtgctctggtccctgaccctcgctgtcttctctatcttcggtgctctgcgaactggagcctacatgctctacatcctgatgaccaaaggcctgaaacagtctgtttgtgaccagtccttttacaacggacccgtctcgaaattctgggcttacgcctttgtgctctccaaagctcccgaacttggcgataccatcttcatcattctgcgaaagcagaaactcatcttcctgcactggtatcaccacatcaccgtcctcctgtactcttggtactcctacaaggacatggtggctggaggtggctggttcatgactatgaactacggtgtccacgccgtgatgtactcctactacgccctccgagctgccggtttccgagtctctcgaaagtttgccatgttcatcaccctgtcgcagatcactcagatgctcatgggctgtgtcattaactacctggtcttcaactggatgcagcatgacaatgaccagtgctactcccactttcagaacatcttctggtcctctctcatgtacctctcctaccttctgctcttctgccatttcttctttgaggcctacattggcaaagtgaagaaagccaccaaggctgagtaagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagagagccttgccagcgggctgcttctcggccattcgagcgaacacggccaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccaggagcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccacgaggttattccagtttcggttcttgaaggtctggtggtggcagatgtcatgagacagccatcccatttgctggtagtgcataccgagcagcacagcaccaatgaagtacatctggtactggaccatcaggaagtatccaagcacgccaagacccagggtggtggagatcttgtacgagtaccagaggggagaggcgtcaaacatgccagtggcgatcagctcttctcggagctttcggaaatcctcctgagcttcgttgacggcagcctggggaggcagctcggaggaggggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtaggtagttccgtcgatggtgaggggcagagcctgtcgcttggacttcaccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattcgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagc

SEQ ID NO: 150 - DNA, 13295 bp, Artificial Sequence
  Plasmid pDMW314
  misc_feature (10915)..(10918): n is a, c, g, or t
  misc_feature (10923)..(10923): n is a, c, g, or t
aacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagagagccttgccagcgggctgcttctcggccattcgagcgaacacggccaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccaggagcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccacgaggttattccagtttcggttcttgaaggtctggtggtggcagatgtcatgagacagccatcccatttgctggtagtgcataccgagcagcacagcaccaatgaagtacatctggtactggaccatcaggaagtatccaagcacgccaagacccagggtggtggagatcttgtacgagtaccagaggggagaggcgtcaaacatgccagtggcgatcagctcttctcggagctttcggaaatcctcctgagcttcgttgacggcagcctggggaggcagctcggaggaggggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtaggtagttccgtcgatggtgaggggcagagcctgtcgcttggacttcaccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagccatggtgaatgattcttatactcagaaggaaatgcttaacgatttcgggtgtgagttgacaaggagagagagaaaagaagaggaaaggtaattcggggacggtggtcttttatacccttggctaaagtcccaaccacaaagcaaaaaaattttcagtagtctattttgcgtccggcatgggttacccggatggccagacaaagaaactagtacaaagtctgaacaagcgtagattccagactgcagtaccctacgcccttaacggcaagtgtgggaaccgggggaggtttgatatgtggggtgaagggggctctcgccggggttgggcccgctactgggtcaatttggggtcaattggggcaattggggctgttttttgggacacaaatacgccgccaacccggtctctcctgaattcgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagccatggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggacagtcagaggagtacgtacgctgcttacataatggcgcaacgaccacatgtcccacagatacgcatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgagnnnntcgtnggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaagtaggcgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtcc

SEQ ID NO: 151 - DNA, 15559 bp, Artificial Sequence
  Plasmid pDMW325
catggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgcccactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcgtacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttgcggccgcttagctgcctactcttccttgggacggagtccaagaacacgcaagtgctccaaatgtgaagcaaatgcttgccaaaacgtatccttgacaaggtatggaaccttgtactcgctgcaggtgttcttgatgatggccagaatatcgggataatggtgctgcgacacgttggggaacagatggtgcacagcctggtagttcaagctgccagtgatgctggtccagaggtgcgaatcgtgtgcgtaatcctgcgtagtctcgacctgcatagctgcccagtccttttggatgatcccgttctcgtcaggcaacggccactgaacttcctcaacaacgtggttcgcctggaaggtcagcgccagccagtaagacgacaccatgtccgcgaccgtgaacaagagcagcaccttgcccaggggcagatactgcaggggaacaatcaggcgataccagacaaagaaagccttgccgccccagaacatcacagtgtgccatgtcgagatgggattgacacgaatagcgtcattggtcttgacaaagtacaaaatgttgatgtcctgaatgcgcaccttgaacgccagcagtccgtacaggaaaggaacaaacatgtgctggttgatgtggttgacaaaccacttttggttgggcttgatacgacgaacatcgggctcagacgtcgacacgtcgggatctgctccagcaatgttggtgtaggggtgatggccgagcatatgttggtacatccacaccaggtacgatgctccgttgaaaaagtcgtgcgtggctcccagaatcttccagacagtggggttgtgggtcactgaaaagtgagacgcatcatgaagagggttgagtccgacttgtgcgcacgcaaatcccatgatgattgcaaacaccacctgaagccatgtgcgttcgacaacgaaaggcacaaagagctgcgcgtagtaggaagcgatcaaggatccaaagataagagcgtatcgtccccagatctctggtctattcttgggatcaatgttccgatccgtaaagtagccctcgactctcgtcttgatggttttgtggaacaccgttggctccgggaagatgggcagctcattcgagaccagtgtaccgacatagtacttcttcataatggcatctgcagccccaaacgcgtgatacatctcaaagaccggagtaacatctcggccagctccgagcaggagagtgtccactccaccaggatggcggctcaagaactttgtgacatcgtacaccctgccgcggatggccaagagtaggtcgtccttggtgttatgggccgccagctcttcccaggtgaaggtttttccttggtccgttcccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaacagtgtacgcagatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgcttagtgagtatgctcgtggtaggagtgctcagggttgccaacagcaaggaggttgacgtaggtcactcgaaagcattccagatagggtcggacgtcgtactcgactccgtgcttctcgaagagtgctcgcactcgaggagcaatcttggggtggttgtactgaggcatggaggggaacagatggtgctcgatctggaagttgaggtaggccatccaccagttgacaaagggagagtcggaacagttggtagtgtggttggcagagtacagagcccacgaaatgtgcttggtgggaggaacgacatccttgtgagtatgggagacggcgaagttggtgaagatgtaggtgccaccgacagccacgtagaaggcatacagtcgaagagaggacaggagtcccagatggccaaaggcaaggtgccagagaacgtatcggagacccatgtaggccagttcgagatggttgtgcactcgcagtgcatgattggggtggagaacgaactgccagccgaaagagaccagggagcaaatgatgcctccaaagaagaggggagcttgccaagcaagccaggctttacccttgcctcgtgccttggctccgacaatcttgtggaaggcaacgagaggcatggtctgcaggtcgggatcggttccgagcttctgaggagtggcgtgatgtttgttgtgctggtttctccagtagcagccagacataccacagcccagtccatagatggccatctggagatgtcggtcaatcttgatgttgccagtgagcgagtagtgtccgccttcatgctggagccatccgcatcgaccttgagcaattccagcaacgatggcaccgaggaaccagtatccggaccagatcagctggacgccagcccagtacatggcaagcacctcgacacatcggtaggacacgtgcaccagattgggctcgaagtaaccttcctctttcagttccagtcgcagcttctcaaagtctctagagatgtcgtcctgtgcatagccagcctcggcaggtcgggagggaagagagtacagcatcttgtcagccttcttcgatcggacgtggaagttgttgtaagcgtcagaagcatctgctccgagctggaacttgatgacggagccaccagggtgtcgcttcacgaacgaggagacgtcgtacactcgtccgttgataatcatctccttctcggcgtcgatagacgagacggtgacatcggcagcctcagatcgggagtcgttggtagcaccgtggtactctcgagggagagtggaagagtgggtcacgtgggctgcagctccggacttgccagcgaccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacagccattgttgtatgtgttttggtgatgtcacgaaaaggacgacgcagcatagatatatatggacgtggaaactaggagaaggaaccttattgctgatccgtaaaattatcgtggaaagaggtggggagggaagatatgggtatggggagatgcaggagcgacaaaacacgcaaatcggagccgttaacctcacaaatatcgccaattcctcccccacagctccccaaacagcccgttgagcgcttttgcccaaccctctccagtccaaaaaaaaccctattgtctggtgacgtctcctacccatgcacctcgtggttgctgtataactggggactccacgacccgaggtcaattaggccacgtgacacccaattgtgtcgctcgcacctcaattgaagactaagctcgttccgccacctcaattgaacccatatgagcaccaatcgccctcaccgcaacataaaacgctcctcatagactagtgctatccaaacgctattatgacgtgacgctgaatagggttgcgcttaaacgaggacagttgtcttattttggggcaaggttagggcatcgaggcagtctgtaactgtcagtaattgcattgtatcttcccctttgtcacggacttgcccctgacactggttggttgtgtcacatttgtcctcaaacaaagtggttcacgccttgatttgatctgaacccaaaacctgagtgagcacatggagaaggttaaaaacaaaccgctctcaacggatgcaacccaaaccctagtgaactgtgactgcgaattctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccagatctgcgtacactgtttaaacagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaac

SEQ ID NO: 152 - DNA, 16325 bp, Artificial Sequence
  Plasmid pZKSL5598
cgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaacagtgtacgcagatcccgtcaacagttttatatatcgtagttacaaccatcaacactttttggtaagtgtaccattctatactccaactggtctgcaactgtacaagtagacatgttaatggtagttaataacatctacagcagaacctatggtaaagacattgcatttttacaggaagtatcgtcctacacgttgataaatccaaagatgcggaacttcttccacttttatcatcatcccctactcgtacactcgtactctttgttcgatcgcgattcatttctataaataatcttgtatgtacatgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagccatggtaccagagctgggttagtttgtgtagagagtgtgtgttgctagcgactttcggattgtgtcattacacaaaacgcgtcgtctcgacactgatcttgtcgtggatactcacggctcggaattctgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaatgttcctctatagtagatctgcgtacactgtttaaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtgaactcttcccatcaccaataaagactcatactacaatcacgagcgcttcagctgccactatagtgttggtgacacaatacccctcgatgctgggcattactgtagcaagagatattcatttcatggcgcattttccagtctacctgactttttagtgccgatttcttctccacattttacgctcagtgtgaaaagttggagtcgacttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatgggaacggaccaaggaaaaaccttcacctgggaagagctggcggcccataacaccaaggacgacctactcttggccatccgcggcagggtgtacgatgtcacaaagttcttgagccgccatcctggtggagtggacactctcctgctcggagctggccgagatgttactccggtctttgagatgtatcacgcgtttggggctgcagatgccattatgaagaagtactatgtcggtacactggtctcgaatgagctgcccatcttcccggagccaacggtgttccacaaaaccatcaagacgagagtcgagggctactttacggatcggaacattgatcccaagaatagaccagagatctggggacgatacgctcttatctttggatccttgatcgcttcctactacgcgcagctctttgtgcctttcgttgtcgaacgcacatggcttcaggtggtgtttgcaatcatcatgggatttgcgtgcgcacaagtcggactcaaccctcttcatgatgcgtctcacttttcagtgacccacaaccccactgtctggaagattctgggagccacgcacgactttttcaacggagcatcgtacctggtgtggatgtaccaacatatgctcggccatcacccctacaccaacattgctggagcagatcccgacgtgtcgacgtctgagcccgatgttcgtcgtatcaagcccaaccaaaagtggtttgtcaaccacatcaaccagcacatgtttgttcctttcctgtacggactgctggcgttcaaggtgcgcattcaggacatcaacattttgtactttgtcaagaccaatgacgctattcgtgtcaatcccatctcgacatggcacactgtgatgttctggggcggcaaggctttctttgtctggtatcgcctgattgttcccctgcagtatctgcccctgggcaaggtgctgctcttgttcacggtcgcggacatggtgtcgtcttactggctggcgctgaccttccaggcgaaccacgttgttgaggaagttcagtggccgttgcctgacgagaacgggatcatccaaaaggactgggcagctatgcaggtcgagactacgcaggattacgcacacgattcgcacctctggaccagcatcactggcagcttgaactaccaggctgtgcaccatctgttccccaacgtgtcgcagcaccattatcccgatattctggccatcatcaagaacacctgcagcgagtacaaggttccataccttgtcaaggatacgttttggcaagcatttgcttcacatttggagcacttgcgtgttcttggactccgtcccaaggaagagtaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggtcgctggcaagtccggagctgcagcccacgtgacccactcttccactctccctcgagagtaccacggtgctaccaacgactcccgatctgaggctgccgatgtcaccgtctcgtctatcgacgccgagaaggagatgattatcaacggacgagtgtacgacgtctcctcgttcgtgaagcgacaccctggtggctccgtcatcaagttccagctcggagcagatgcttctgacgcttacaacaacttccacgtccgatcgaagaaggctgacaagatgctgtactctcttccctcccgacctgccgaggctggctatgcacaggacgacatctctagagactttgagaagctgcgactggaactgaaagaggaaggttacttcgagcccaatctggtgcacgtgtcctaccgatgtgtcgaggtgcttgccatgtactgggctggcgtccagctgatctggtccggatactggttcctcggtgccatcgttgctggaattgctcaaggtcgatgcggatggctccagcatgaaggcggacactactcgctcactggcaacatcaagattgaccgacatctccagatggccatctatggactgggctgtggtatgtctggctgctactggagaaaccagcacaacaaacatcacgccactcctcagaagctcggaaccgatcccgacctgcagaccatgcctctcgttgccttccacaagattgtcggagccaaggcacgaggcaagggtaaagcctggcttgcttggcaagctcccctcttctttggaggcatcatttgctccctggtctctttcggctggcagttcgttctccaccccaatcatgcactgcgagtgcacaaccatctcgaactggcctacatgggtctccgatacgttctctggcaccttgcctttggccatctgggactcctgtcctctcttcgactgtatgccttctacgtggctgtcggtggcacctacatcttcaccaacttcgccgtctcccatactcacaaggatgtcgttcctcccaccaagcacatttcgtgggctctgtactctgccaaccacactaccaactgttccgactctccctttgtcaactggtggatggcctacctcaacttccagatcgagcaccatctgttcccctccatgcctcagtacaaccaccccaagattgctcctcgagtgcgagcactcttcgagaagcacggagtcgagtacgacgtccgaccctatctggaatgctttcgagtgacctacgtcaacctccttgctgttggcaaccctgagcactcctaccacgagcatactcactaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttgacaatggatggtgtgtcgtatcaggctggggaacaattgtgcttaagtatgctgcagttgagtaagagtcatcgctccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagttaattaaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagagagccttgccagcgggctgcttctcggccattcgagcgaacacggccaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccaggagcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccacgaggttattccagtttcggttcttgaaggtctggtggtggcagatgtcatgagacagccatcccatttgctggtagtgcataccgagcagcacagcaccaatgaagtacatctggtactggaccatcaggaagtatccaagcacgccaagacccagggtggtggagatcttgtacgagtaccagaggggagaggcgtcaaacatgccagtggcgatcagctcttctcggagctttcggaaatcctcctgagcttcgttgacggcagcctggggaggcagctcggaggaggggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtaggtagttccgtcgatggtgaggggcagagcctgtcgcttggacttcaccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccat

SEQ ID NO: 153 - DNA, 8015 bp, Artificial Sequence
  Plasmid pMLPAT-17
ctccatggtcgggtccgtcacccgacccacaaaggccctgctctatggatcagccctcttcagtttctgctcattgctcaatgtggtccaggtgttctccatactcctgcagccgttctcgaagcgtctcttctttgaagtgaacgctcgcgtggccggctccatgtggaaggttatgcagctgattatggagaaaaagcacaaggccgccatcaycttctcaggagacaagatccctcaccacgagagtgccatcgtctttggcaaccaccggtcctttgtcgacttttacatgtttcacaccgttgctgctyggagaggcatgctcaactatatgaagtactttgccaaggactctctgaaatacattccattctatggatggggcatgtggaycatgggaatgctattcatcaatcgcaactggcagcaggatcagctcaagatcaacaagatgtttgcacggatattggacatccaagcgcccgtttgggtcgccagtttcttggagggctctcggttgacgcccagcaaactgkctgcctctcaaaagttcatgctgggacgcggattgcctctgctgtcaaacgtcatgatgcccaggaccaagggattcattgcctgtgtcaacaaattccggggaactcatgtgaaatgtgtttatgatttcacgttcgcctactaccacaagaccaagggctttggagtgyctccagatctggtccgtgttcacastggccagctcagccccgagtacaaattccatgttcatgtgagacgctatcagctcgacgatctgcccacggatgaggagaagctgagcgagtgggtggtccaaaagtatgtggagaaggacgcctttttggagcagatgaaggagaattggacagatggtattgatgggggtgtgtggtcagagaactggatgtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagct

SEQ ID NO: 154 - DNA, 8411 bp, Artificial Sequence
  Plasmid pMLPAT-Int
cgataccatggtcgggcaatgagaacggcagcaactgcaatcacagcgacatatatccaactgttcatgtttggttttcggatagtcacacaccttaattttgatgcacgctttatggagtctctctctctttttctctctctcttgtcgtcgctctttcttgtttttcaaccacccacttgattcctgcaaacaaactacccacactaattttttttcgctgcataccctcaaatgagcctaattggcgtgtgtctccgcacaaaaacacaccatgcacggctgggcttgttgggaaactttgtcaggggggtccagggggccattggcagacttggccacgtgtgctcatctcggcttcgtcgttattacgtgtctgtgtaatcaaagtcgggcgttttttgcgccatgtgtccgcatgaaattggcccctcttgaagtcccttgtgcacctacacgtgccgaaatgaaggttggagtcagcggggtcatgccgtggtattatgctgtggcatgtggcattaagctgtggcatcaagccgtggaatcaagccgtggttcacgcccttgattgcgcaggcacatggcgccattcttgcctctgctgtaagcccggctttgtgtgattcagagacgctgctaccgcacaactgcccatactccttctcctactgtatacatccacccctcatgctgataacattatcatctcatctcaactcaacatttccaccaacttgggatcaaaaacacgttctaatactgtacactgtctacgatataattaccgtacagtgtggttataatgaacatctattagagagaattgtttgttgctcgtatcagtcattgggaagcgggataccatgtcattttcacctatatcaaccatgaaactacagtatgtacagtagaagtatatactgtactgttttgtaactatatgtacagtagaagtatatactatactgttattaactatacttgtgactagtgttccaaactacaagtatatactgtacttgtacacgactatccgaccagtatccagtatacaataaccaactactctacgtacgtactaaactaaacaaatagatcaatgctcaatgtcgagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgagtctagagcagggtgttggaggggatggagaggttgagtaaagcggaagttgcggtttgctggtcgcgttttaatcttcttttgtaatttaatctcggtatgccgacgtgtttcggcgagttaattttagctgtcaaaaaaatggatcaccaggatagacaaagaagagagtgggacaaggatctttccagccgctaatatcggccagtttaagagcaattcacggtccctggagtccatataacaacgccaatctcgcacttgtctgctccctcgtcacccgtccaactgtccaatccaatctatgcctctcatgatcatcttcacactacagtagagtaggtaaaggtagacttatgggctcctcgaataattggactctgtctaaaccttgtgaagttacctcggtcggtagagttcggctggaaggccatgattactaacaacatcgtacgagagaaaatcaagatgagtaatacaatctcgatgagtaatacaatctcgatgagtaatacaatctcgatgagtaagactaggtggtgtcacgacttttagaggaatgagcagctttcagggttattatagagacacgtccgcggacgaagtagctggtacatcgagcataagcatggtacaagtaggagtagactaaaaaccaacagtttgaatagtccatgacagtacgggcgggtacgactgatctaagagaactggggtatacacgatatagcacagtacagagaaagtgggctcgttttgcgttggtaatcgaggtagatttcgttgctatattaatccattcacccatagctccacagccaatggttcgccgtgggtgtcgatctgaaaaatgtttcatattacctatctctctcctaaagtagctacaagcacttcttgtgctgcagtctgcggccgctcacatccagttctctgaccacacacccccatcaataccatctgtccaattctccttcatctgctccaaaaaggcgtccttctccacatacttttggaccacccactcgctcagcttctcctcatccgtgggcagatcgtcgagctgatagcgtctcacatgaacatggaatttgtactcggggctgagctggccastgtgaacacggaccagatctggagrcactccaaagcccttggtcttgtggtagtaggcgaacgtgaaatcataaacacatttcacatgagttccccggaatttgttgacacaggcaatgaatcccttggtcctgggcatcatgacgtttgacagcagaggcaatccgcgtcccagcatgaacttttgagaggcagmcagtttgctgggcgtcaaccgagagccctccaagaaactggcgacccaaacgggcgcttggatgtccaatatccgtgcaaacatcttgttgatcttgagctgatcctgctgccagttgcgattgatgaatagcattcccatgrtccacatgccccatccatagaatggaatgtatttcagagagtccttggcaaagtacttcatatagttgagcatgcctctccragcagcaacggtgtgaaacatgtaaaagtcgacaaaggaccggtggttgccaaagacgatggcactctcgtggtgagggatcttgtctcctgagaagrtgatggcggccttgtgctttttctccataatcagctgcataaccttccacatggagccggccacgcgagcgttcacttcaaagaagagacgcttcgagaacggctgcaggagtatggagaacacctggaccacattgagcaatgagcagaaactgaagagggctgatccatagagcagggcctttgtgggtcgggtgacggacccgaccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattggggctgttttttgggacacaaatacgccgccaacccggtctctcctgaattctgcagatgggctgcaggaattccgtcgtcgcctgagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaattactgtcgaaat

SEQ ID NO: 155 - DNA, 7323 bp, Artificial Sequence
  Plasmid pZUF-MOD-1
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggatccaggcctgttaacggccattacggcctgcaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 156 - DNA, 8666 bp, Artificial Sequence
  Plasmid pMDGAT1-17
  misc_feature (467)..(467): n is a, c, g, or t
catggcagagtcgacaacaacgacatgtgcaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgtgncagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcctcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 157 - DNA, 8084 bp, Artificial Sequence
  Plasmid pMDGAT2-17
catggcgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtattgtaactggatcggatggaaacactttgcacagtactttcctatgacccttgtcaaggagggagagctggacccatccaagaactacatctttgggtatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcctttgtcaatggcgcaagtctggtacctacgttggcctttggtgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaataggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 158 - DNA, 9239 bp, Artificial Sequence
  Plasmid pMGPAT-17
  misc_feature (1510)..(1510): n is a, c, g, or t
  misc_feature (1577)..(1577): n is a, c, g, or t
  misc_feature (1584)..(1584): n is a, c, g, or t
  misc_feature (1712)..(1712): n is a, c, g, or t
  misc_feature (1729)..(1729): n is a, c, g, or t
  misc_feature (1759)..(1759): n is a, c, g, or t
  misc_feature (1820)..(1820): n is a, c, g, or t
  misc_feature (1822)..(1822): n is a, c, g, or t
  misc_feature (1831)..(1831): n is a, c, g, or t
  misc_feature (1841)..(1841): n is a, c, g, or t
  misc_feature (1913)..(1913): n is a, c, g, or t
  misc_feature (1941)..(1941): n is a, c, g, or t
  misc_feature (2033)..(2033): n is a, c, g, or t
  misc_feature (2130)..(2130): n is a, c, g, or t
ccatggatcctcagatctacgactttgtgtcgttcttcttcactatcctgctcgacatcttcttcagggagattcgtcccagaggcgcacacaagattccacaaaaaggccccgtgatctttgtcgccgctcctcatgccaatcagtttgtcgatcctctcgtcttgatgcgagagtgcggccgcagagtctcattccttgcagccaaaaagtccatggaccgccggtggattggtgcaatggcacgctcgatgaatgcgattcctgttgagcgcccccaggaccttgctaaagccggctcgggaatcatcaaacttctggatcgttatggcgaccctcttcgggtcaccggtgtcggcactaaattcacaaaggagctgcttgtgggcgaccagatctcccttccaaaggacgtcggtgtcycagctgtgggcgagatcatatctgataccgagctgattgtcaagaaggaattcaaagagctcaaggcccttgagttgctgaccagtgctgaaggaaccaagtacaaatgcctaccccatatggaccagacgaacgtctacaaaactgtctttgagcgccttaacgcaggacattgcgttggcattttccccgagggaggctcccacgatcgtgctgaaatgctgccattgaaagctggagtcaccatcatggccctgggcgcattagccgccaacccttccttggatctcaagattgtcacctgcggcctcaactactttcacccgcatcgcttccgctcgcgtgcagtagtcgagtttggcgagccattgacggtttcgcctgagctggtcgaaatgtacaagcgaggcggggcggaaaagcgagaggcttgcggaaaactgctcgacacgatctatgaagctctccgcggtgtcactctcaacgcgcctgattacgagacattgatggtcattcaagcggcccgtcgcctttacaagcctactcatcgcaagctgcagatctcgcaggtcgttgagttgaaccgtaggttcgtcgcaggatacatgcacttcaaggacaatccaaaagtcattgaagccaaggataaagtcatgcattacaacactcagctgcggtaccatggattgcgggatcaccaagtgaatattcgcaccaccaggaagcacgctatcggcatgctcatctctcggctgatccagatgatctttttgagttgtctggcgctacctggaacyctgatgaatcttccggtcgccattgtcgctcgtgtcatcagcaacaaaaaggccaaagaggcgctggctgcctcgacagtcaaaattgctggaagggacgtcttggctacgtggaagttgctggtcgctctaggattgatgcctgttctgtacttcacgtactccgtcatggtcttcatctattgcagccgcttcgacctatcgttcaagtcgcgtcttttggttgcttgggcagcatgggcgcttattccttttgtaacctacgcaagcatccgctttggtgaagttgntatcgatatcttcaagtctattcgcccattgttcctgtccatcatcccgggcgaggagagcacgatnaacgacntgcgcaaggcgcgcgcagaacttcaaaagaccatcaccaatctcatcaatgagctagcgccgcagatatatcccgactttgattcaaagcgcatcctcgatccatcccctgcagatcgtcccagccgntcagcatcaggcaccanccttgcacagacgattttcaacacggctgntcagcccttgaaccaatggctaggcaaggatggccgctttgaatgggagcgtaccgaggantntgatgcagntgacgtgttnttctttttggacccagcgagaggaattatggggcggtctagggcgtcgtcttggggaggtggagcatttacncctgctgttgatgggtcgcgatcccggnatcggagcaggacaagcagcttcacgtcgggccagatccagctgggcgagggcttcaaactcgaggcactgacggagctgccgcgggacaanccttttgcagaagtgaccaggcggttgagtgtgagccgaatgcagagatatgggctggagggtatgacgcgctcggatacggatgaaaacgaaggcnccgccaagtcaaaagacatttaggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctct

SEQ ID NO: 159 - DNA, 5031 bp, Artificial Sequence
  Plasmid pZF5T-PPC-E3
atggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccargcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaaggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgtttaaacagtgtacgcagtactatagaggaacatcgattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctcca

SEQ ID NO: 160 - DNA, 8462 bp, Artificial Sequence
  Plasmid pZUF6S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagc

SEQ ID NO: 161 - DNA, 11046 bp, Artificial Sequence
  Plasmid pZUF6S-E3WT
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctatggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccargcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaaattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgccttttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagc

SEQ ID NO: 162 - DNA, 6561 bp, Artificial Sequence
  Plasmid pZKUGPYE1-N
gtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggctgccgtccctattgaattcaacgtcccctccgtggaccgaccctttggtatctacctctgggccatctttgaccaggcctgggagaagcttttcggctggcccgcgtcctctttcattttcgtgcgaaatgaccccaacatccccttttcctctacccctcccgtgatcattgccatcattgtgtactacattgtcatctttggcggccgagaggtgatgcgaaacctgtctcccatccgactcaactggctcttccagatccacaacatcttcctcacccttctgtccggtatgctcctcctcctcctcgttgagcagctcttccccatcattgtccgacagggtatcctctacgccatctgcgactacggatcttggactcagcccattgtcttctgctactacctcaactacctgaccaagtactttgagctgatcgacaccgttttccttgtgctgcgaaagaagaagctgactttcctccacacctaccatcacggtgccactgctcttctgtgctacacccagctcattggtaagacctcggtctcttgggtccccatcacccttaacctgtttgtccacgttgtcatgtacttctactacttcctggctgcgcgaggtatccgagtgtggtggaaggagtgggtcacccggctccagatcatccagttcgttatcgatcttggatttgtctactttgcctcttacacctacttcacctctacctactggccctggatgcccaacatgggctcttgtgccggcgaggagtttgctgctatttacggctgtggtctgctgacctcttacctcttcctcttcatcgccttctacatcaactcttaccgaaagccctcttccaagggaccttccaagcctgttgttgctgtcgatggccctgttggcggcgtcaacgcccagactggtgcttctcgaggccagaccactacccgatctcgacgagcataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 163 - DNA, 6498 bp, Artificial Sequence
  Plasmid pZKUGPYE2
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggtctcgtcaatctcgcccgacctatactcgtccttctcgttcaaaaactcgctcgccgaggccatgccctccgtgccacacgaactcatcaactcaaaaacactctcatggatgtacaatgcctctctggacattcgggttcctctgactatcggaaccatctacgccgtctccgtgcacctgaccaactcatctgaacgaatcaagaaacgccagcccattgcctttgccaagaccgcactcttcaagtggctctgtgtcctccacaatgcaggtctgtgtctctactcagcatggacctttgtcggtatcctcaacgccgtcaaacacgcctaccaaatcacaggagacagctccgcccccttctccttcaacaccctctggggatcgttttgttcacgtgactccctctgggtcaccggcctcaactactacggatactggttctatctgtccaaattctacgaagtggtggacaccatgatcatcctcgcaaagggaaaaccgtcctcaatgctccagacataccaccacaccggcgccatgttctccatgtgggccggcatccgattcgcctctccccccatctggatctttgtggttttcaactccctcatccacacaatcatgtacttttactacaccctcaccaccctcaagatcaaggttcccaagatcctcaaggcatctctgaccaccgcccagatcacccagattgtcggaggtggcatcctggctgcctcccacgcctttatttattacaaggaccaccagactgagaccgtctgttcttgtctcactacccagggtcagtttttcgctctcgccgtcaatgtcatctatctgagtcctctggcctatctctttattgccttctggattcgatcttacttgaaggccaagtccaactaagc

SEQ ID NO: 164 - DNA, 10195 bp, Artificial Sequence
  Plasmid pZUF6TYE2
ggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggtctcgtcaatctcgcccgacctatactcgtccttctcgttcaaaaactcgctcgccgaggccatgccctccgtgccacacgaactcatcaactcaaaaacactctcatggatgtacaatgcctctctggacattcgggttcctctgactatcggaaccatctacgccgtctccgtgcacctgaccaactcatctgaacgaatcaagaaacgccagcccattgcctttgccaagaccgcactcttcaagtggctctgtgtcctccacaatgcaggtctgtgtctctactcagcatggacctttgtcggtatcctcaacgccgtcaaacacgcctaccaaatcacaggagacagctccgcccccttctccttcaacaccctctggggatcgttttgttcacgtgactccctctgggtcaccggcctcaactactacggatactggttctatctgtccaaattctacgaagtggtggacaccatgatcatcctcgcaaagggaaaaccgtcctcaatgctccagacataccaccacaccggcgccatgttctccatgtgggccggcatccgattcgcctctccccccatctggatctttgtggttttcaactccctcatccacacaatcatgtacttttactacaccctcaccaccctcaagatcaaggttcccaagatcctcaaggcatctctgaccaccgcccagatcacccagattgtcggaggtggcatcctggctgcctcccacgcctttatttattacaaggaccaccagactgagaccgtctgttcttgtctcactacccagggtcagtttttcgctctcgccgtcaatgtcatctatctgagtcctctggcctatctctttattgccttctggattcgatcttacttgaaggccaagtccaactaagc

SEQ ID NO: 165 - DNA, 6561 bp, Artificial Sequence
  Plasmid pKUGPYE1
gtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggctgccgtccctattgaattcaacgtcccctccgtggaccgaccctttggtatctacctctgggccatctttgaccaggcctgggagaagcttttcggctggcccgcgtcctctttcattttcgtgcgaaatgaccccaacatccccttttcctctacccctcccgtgatcattgccatcattgtgtactacattgtcatctttggcggccgagaggtgatgcgaaacctgtctcccatccgactcaactggctcttccagatccacaacatcttcctcacccttctgtccggtatgctcctcctcctcctcgttgagcagctcttccccatcattgtccgacagggtatcctctacgccatctgcgactacggatcttggactcagcccattgtcttctgctactacctcaactacctgaccaagtactttgagctgatcgacaccgttttccttgtgctgcgaaagaagaagctgactttcctccacacctaccaccatggtgccactgctcttctgtgctacacccagctcattggtaagacctcggtctcttgggtccccatcacccttaacctgtttgtccacgttgtcatgtacttctactacttcctggctgcgcgaggtatccgagtgtggtggaaggagtgggtcacccggctccagatcatccagttcgttatcgatcttggatttgtctactttgcctcttacacctacttcacctctacctactggccctggatgcccaacatgggctcttgtgccggcgaggagtttgctgctatttacggctgtggtctgctgacctcttacctcttcctcttcatcgccttctacatcaactcttaccgaaagccctcttccaagggaccttccaagcctgttgttgctgtcgatggccctgttggcggcgtcaacgcccagactggtgcttctcgaggccagaccactacccgatctcgacgagcataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 166 - DNA, 10809 bp, Artificial Sequence
  Plasmid pZUF6FYE1
taagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgctccctctgtgcgaacctttacccgagccgaggttctgaacgctgaggctctgaacgagggcaagaaggacgctgaggctcccttcctgatgatcatcgacaacaaggtgtacgacgtccgagagttcgtccctgaccatcctggaggctccgtgattctcacccacgttggcaaggacggcaccgacgtctttgacacctttcatcccgaggctgcttgggagactctcgccaacttctacgttggagacattgacgagtccgaccgagacatcaagaacgatgactttgccgctgaggtccgaaagctgcgaaccctgttccagtctctcggctactacgactcctctaaggcctactacgccttcaaggtctccttcaacctctgcatctggggactgtccaccgtcattgtggccaagtggggtcagacctccaccctcgccaacgtgctctctgctgccctgctcggcctgttctggcagcagtgcggatggctggctcacgactttctgcaccaccaggtcttccaggaccgattctggggtgatctcttcggagccttcctgggaggtgtctgccagggcttctcctcttcctggtggaaggacaagcacaacactcaccatgccgctcccaacgtgcatggcgaggatcctgacattgacacccaccctctcctgacctggtccgagcacgctctggagatgttctccgacgtccccgatgaggagctgacccgaatgtggtctcgattcatggtcctgaaccagacctggttctacttccccattctctccttcgctcgactgtcttggtgcctccagtccattctctttgtgctgcccaacggtcaggctcacaagccctccggagctcgagtgcccatctccctggtcgagcagctgtccctcgccatgcactggacctggtacctcgctaccatgttcctgttcatcaaggatcctgtcaacatgctcgtgtacttcctggtgtctcaggctgtgtgcggaaacctgctcgccatcgtgttctccctcaaccacaacggtatgcctgtgatctccaaggaggaggctgtcgacatggatttctttaccaagcagatcatcactggtcgagatgtccatcctggactgttcgccaactggttcaccggtggcctgaactaccagatcgagcatcacctgttcccttccatgcctcgacacaacttctccaagatccagcctgccgtcgagaccctgtgcaagaagtacaacgtccgataccacaccactggtatgatcgagggaactgccgaggtcttctcccgactgaacgaggtctccaaggccacctccaagatgggcaaggctcagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggctgccgtccctattgaattcaacgtcccctccgtggaccgaccctttggtatctacctctgggccatctttgaccaggcctgggagaagcttttcggctggcccgcgtcctctttcattttcgtgcgaaatgaccccaacatccccttttcctctacccctcccgtgatcattgccatcattgtgtactacattgtcatctttggcggccgagaggtgatgcgaaacctgtctcccatccgactcaactggctcttccagatccacaacatcttcctcacccttctgtccggtatgctcctcctcctcctcgttgagcagctcttccccatcattgtccgacagggtatcctctacgccatctgcgactacggatcttggactcagcccattgtcttctgctactacctcaactacctgaccaagtactttgagctgatcgacaccgttttccttgtgctgcgaaagaagaagctgactttcctccacacctaccatcacggtgccactgctcttctgtgctacacccagctcattggtaagacctcggtctcttgggtccccatcacccttaacctgtttgtccacgttgtcatgtacttctactacttcctggctgcgcgaggtatccgagtgtggtggaaggagtgggtcacccggctccagatcatccagttcgttatcgatcttggatttgtctactttgcctcttacacctacttcacctctacctactggccctggatgcccaacatgggctcttgtgccggcgaggagtttgctgctatttacggctgtggtctgctgacctcttacctcttcctcttcatcgccttctacatcaactcttaccgaaagccctcttccaagggaccttccaagcctgttgttgctgtcgatggccctgttggcggcgtcaacgcccagactggtgcttctcgaggccagaccactacccgatctcgacgagcataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaat

SEQ ID NO: 167 - DNA, 8273 bp, Artificial Sequence
  Plasmid pYCPT1-17
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaagc

SEQ ID NO: 168 - DNA, 7822 bp, Artificial Sequence
  Plasmid pZP2l7+Ura
aaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggctgaggataagaccaaggtcgagttccctaccctgactgagctgaagcactctatccctaacgcttgctttgagtccaacctcggactctcgctctactacactgcccgagcgatcttcaacgcatctgcctctgctgctctgctctacgctgcccgatctactcccttcattgccgataacgttctgctccacgctctggtttgcgccacctacatctacgtgcagggtgtcatcttctggggtttctttaccgtcggtcacgactgtggtcactctgccttctcccgataccactccgtcaacttcatcattggctgcatcatgcactctgccattctgactcccttcgagtcctggcgagtgacccaccgacaccatcacaagaacactggcaacattgataaggacgagatcttctaccctcatcggtccgtcaaggacctccaggacgtgcgacaatgggtctacaccctcggaggtgcttggtttgtctacctgaaggtcggatatgctcctcgaaccatgtcccactttgacccctgggaccctctcctgcttcgacgagcctccgctgtcatcgtgtccctcggagtctgggctgccttcttcgctgcctacgcctacctcacatactcgctcggctttgccgtcatgggcctctactactatgctcctctctttgtctttgcttcgttcctcgtcattactaccttcttgcatcacaacgacgaagctactccctggtacggtgactcggagtggacctacgtcaagggcaacctgagctccgtcgaccgatcgtacggagctttcgtggacaacctgtctcaccacattggcacccaccaggtccatcacttgttccctatcattccccactacaagctcaacgaagccaccaagcactttgctgccgcttaccctcacctcgtgagacgtaacgacgagcccatcattactgccttcttcaagaccgctcacctctttgtcaactacggagctgtgcccgagactgctcagattttcaccctcaaagagtctgccgctgcagccaaggccaagagcgactaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtc

SEQ ID NO: 169 - DNA, 7930 bp, Artificial Sequence
  pYCPT1-ZP2l7
catgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcac

SEQ ID NO: 170 - DNA, 8179 bp, Artificial Sequence
  Plasmid pTEF::ISC1
gcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggacaacagaaaagacagagatgttcacgagaggaaggaagatggtcaatctgagtttgaagcactgaacgggaccaacgcaattatgtccgataatagtaaagcgtattccataaagtttctgaccttcaatacatgggggttaaaatacgtctccaaacaccgtaaagaaagactcagagcaattgctgataaattggcgggccactcaatgcttacgccaatatctgacgagttgttgcccaatggtggagatagtaatgaaaacgaagattacgacgtgattgccttacaagaaatctggtgtgtggaagactggaagtatctagcttctgcgtgtgcctccaagtatccgtatcagcgtttgttccattctggtattctgacggggcctgggttggccatactgtccaaggtcccgatagagtcgacctttctttaccggttcccgataaacggtagaccgagtgcggtgttccgtggcgactggtacgtagggaaatctatagcaatcaccgtattgaacacaggaacccgccccattgcaataatgaacagtcacatgcacgccccatacgccaagcagggtgatgccgcctacttgtgccacagatcttgtcaggcctgggatttcagcaggctcattaagctttacaggcaggccggttatgcggtgattgtggtgggtgacttaaactccagaccgggctcactgccccacaaatttctcacgcaggaggccggcctggtcgactcctgggagcaattgcatgggaagcaagacttggcggtgatcgctcgtctgtctccattgcaacaattgcttaagggctgtaccacgtgcgattcgctgctcaacacatggagggcccaaagacaacccgatgaggcatgcaggttggattatgctcttatcgaccctgatttcttgcaaacagtagacgcaggtgtcaggttcactgaacggatccctcacctggactgcagtgtctctgaccattttgcatactcatgcacccttaacatcgtcccacagggcacagagtcccgtccatccacctccgttaagcgtgcgaagactcatgatagagagctgatcttgcagagatactccaactacgaaaccatgatagaatgcatccacacgtacttgaagacagcccaaagacagaaatttttccgtggcctacatttctgggcctcaatacttctcctaatagcgtcgttggtcgtgacaacgtttactgcaaacaaggcaggctggtcctccatcttctgggtccttttcgctattgctgtctccatctcgggcaccatcgacggtgccatctccttcttgtttggcaggtctgaaatcagagccctcatcgaagtcgaacaagaggttctggacgcggagcaccacctgcaaactttcttgagcgagaaatga

SEQ ID NO: 171 - DNA, 8196 bp, Artificial Sequence
  Plasmid pY20
tggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaataatttgaatcgaatcggagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccatggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccaaacaccactaaaaccccacaaaatatatcttaccgaatatacagtaacaagctaccaccacactcgttgggtgcagtcgccagcttaaagatatctatccacatcagccacaactcccttcctttaataaaccgactacacccttggctattgaggttatgagtgaatatactgtagacaagacactttcaagaagactgtttccaaaacgtaccactgtcctccactacaaacacacccaatctgcttcttctagtcaaggttgctacaccggtaaattataaatcatcatttcattagcagggcagggccctttttatagagtcttatacactagcggaccctgccggtagaccaacccgcaggcgcgtcagtttgctccttccatcaatgcgtcgtagaaacgacttactccttcttgagcagctccttgaccttgttggcaacaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaaaggatccactagttctagagcggccgcttaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcgg

SEQ ID NO: 172 - DNA, 5105 bp, Artificial Sequence
  Plasmid pLV13
  misc_feature (4446)..(4446): n is a, c, g, or t
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcagctttgagcttggagaagtatccgtctcggtgctccaaatcagggtaggacagtctccagtcgtacgccgcagcagacattgtatccgtatcgtatccaataacagccaggttctcgagcagcttgttccacagccagtagcctgccataaagaagtcggcggaggcaaatccctgggcggctcgcagcttgaaatggggagggtctagaccggtctctgtgtccagcatcaggttctgcagccagcagtacttgtccagcagcatgactcggatcatgtaccaggagccccacattcgctttctgaagtgcgactcggtgggacactccnyggttccctccagggaccagctctccagtcccgtggagatgacgccgggcaccagcaccaccgggtacttggcgttgagtccctcgctcttcatagccttgcccacagcaaaaggggcagccttctgttcgcttttctggtgcttctcgatcttgagatctagaatacagaagtcaacggttcatccatggtgaggtcttagcagagtactcggtcaagactccttgaacttgatgaagttgccaaaggtgacattctggccgggctcgtcatcaggggctccagaatgatcaccccagatagccttaccacccttgggaatcatggaagcaattcctccccatgttcgcagcagatcggctcgctctcgtcgagagaagaactgctccagtccatacacagccatcgcgttcagctgcacggtatccttcatttctccagacagaagagcaaccagggtcttgggagtacccagcatggagccggaaatgtcgacaaaggattcaatatggtcattgacccagttgggacctcctcctccatatccctcggcctcagcccacttcatgaagtagaagatgacctgggagcccatggaatggcccgtcagaactgtcttctcacctgtcatacgcttagtctcttcgattgaggatccg

SEQ ID NO: 173 - DNA, 971 bp, Yarrowia lipolytica
  misc_feature: Promoter GPD
gacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaacatg

SEQ ID NO: 174 - DNA, 1174 bp, Yarrowia lipolytica
  misc_feature: Promoter GPDIN
aaacacgcagtaggatgtcctgcacgggtctttttgtggggtgtggagaaaggggtgcttggagatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaacatggccatcaaagtcggtattaacggattcgggcgaatcggacgaattgtgagtaccatagaaggtgatggaaacatgacccaacagaaacagatgacaagtgtcatcgacccaccagagcccaattgagctcatactaacagtcgacaacctgtcgaaccaattgatgactccccgacaatgtactaacacaggtcctgccc

SEQ ID NO: 175 - DNA, 878 bp, Yarrowia lipolytica
  misc_feature: Promoter GPM
gcctctgaatactttcaacaagttacacccttcattaattctcacgtgacacagattattaacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaaaaatg

SEQ ID NO: 176 - DNA, 1001 bp, Yarrowia lipolytica
  misc_feature: Promoter FBA
taaacagtgtacgcagtactatagaggaacaattgccccggagaagacggccaggccgcctagatgacaaattcaacaactcacagctgactttctgccattgccactagggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctcc

SEQ ID NO: 177 - DNA, 973 bp, Yarrowia lipolytica
  misc_feature: Promoter FBAIN
aaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctcc

SEQ ID NO: 178 - DNA, 924 bp, Yarrowia lipolytica
  misc_feature: Promoter FBAINm
aaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtacc

SEQ ID NO: 179 - DNA, 1130 bp, Yarrowia lipolytica
caacttttcttgtcgacctgagataccgaggttgcgcaggggatcaacttttgtgtctcagagggacccaagtgcgtacggagagtacagtacatactgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttaatcggctgtcttacgtatttggcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaa

SEQ ID NO: 180 - DNA, 778 bp, Yarrowia lipolytica
  misc_feature: Promoter YAT1
ataagtttgcaaaaagatcgtattatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgccatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaatg

SEQ ID NO: 181 - DNA, 436 bp, Yarrowia lipolytica
  misc_feature: Promoter TEF
gaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaaaggatccactagttctagagcggccgcttaaacc

SEQ ID NO: 182 - DNA, 1020 bp, Artificial Sequence
  GPM::FBAIN chimeric Yarrowia lipolytica promoter
gtcgaccattaattctcacgtgacacagattattaacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaaccatggctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctcc

SEQ ID NO: 183 - DNA, 1052 bp, Artificial Sequence
  GPM::GPDIN chimeric Yarrowia lipolytica promoter
gtcgaccattaattctcacgtgacacagattattaacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaaccatggccatcaaagtcggtattaacggattcgggcgaatcggacgaattgtgagtaccatagaaggtgatggaaacatgacccaacagaaacagatgacaagtgtcatcgacccaccagagcccaattgagctcatactaacagtcgacaacctgtcgaaccaattgatgactccccgacaatgtactaacacaggtcctgccc

SEQ ID NO: 184 - DNA, 30 bp, Artificial Sequence
  Primer YL211
tttgtcgacgcagtaggatgtcctgcacgg

SEQ ID NO: 185 - DNA, 34 bp, Artificial Sequence
  Primer YL212
tttccatggttgatgtgtgtttaattcaagaatg

SEQ ID NO: 186 - DNA, 27 bp, Artificial Sequence
  Primer YL376
aatctgcagtggtgcaaacggggcgga

SEQ ID NO: 187 - DNA, 32 bp, Artificial Sequence
  Primer YL377
tttccatgggcaggacctgtgttagtacattg

SEQ ID NO: 188 - DNA, 33 bp, Artificial Sequence
  Primer YL203
tttccatggttgtatgtgttttggtgatgtcac

SEQ ID NO: 189 - DNA, 33 bp, Artificial Sequence
  Primer YL204
tttgtcgaccgtttaagcgcaaccctattcagc

SEQ ID NO: 190 - DNA, 22 bp, Artificial Sequence
  Primer GPAT-5-1
caacttttcttgtcgacctgag

SEQ ID NO: 191 - DNA, 34 bp, Artificial Sequence
  Primer GPAT-5-2
gatcccatggttagcgtgtcgtgtttttgttgtg

SEQ ID NO: 192 - DNA, 33 bp, Artificial Sequence
  Primer ODMW314
cgtgccatggtgtgatgtgtagtttagatttcg

SEQ ID NO: 193 - DNA, 39 bp, Artificial Sequence
  Primer YL341
tttgtcgacgtttaaacagtgtacgcagtactatagagg

SEQ ID NO: 194 - DNA, 34 bp, Artificial Sequence
  Primer ODMW320
cgtgccatggagagctgggttagtttgtgtagag

SEQ ID NO: 195 - DNA, 39 bp, Artificial Sequence; identical to SEQ ID NO: 193
  Primer ODMW341

SEQ ID NO: 196 - DNA, 32 bp, Artificial Sequence
  Primer 27203-F
gatcgtcgacataagtttgcaaaaagatcgta

SEQ ID NO: 197 - DNA, 34 bp, Artificial Sequence
  Primer 27203-R
gatcccatggttgtgaattagggtggtgagaatg

SEQ ID NO: 198 - DNA, 21 bp, Artificial Sequence
  Primer YL-URA-16F
gctcgagctaacgtccacaag

SEQ ID NO: 199 - DNA, 18 bp, Artificial Sequence
  Primer YL-URA-78R
cttggctgccacgagctt

SEQ ID NO: 200 - DNA, 22 bp, Artificial Sequence
  Primer GUS-767F
ccaaaagccagacagagtgtga

SEQ ID NO: 201 - DNA, 22 bp, Artificial Sequence
  Primer GUS-891R
ttcatgacgaccaaagccagta

SEQ ID NO: 202 - DNA, 101 bp, Artificial Sequence
  Primer IL3-1A
gccaacgacgctggcgagcgaatctgggctgccgtcaccgatcccgaaatcctcattggcaccttctcctacctgctcctgaagcctctcctgcgaaactc

SEQ ID NO: 203 - DNA, 101 bp, Artificial Sequence
  Primer IL3-1B
accagagtttcgcaggagaggcttcaggagcaggtaggagaaggtgccaatgaggatttcgggatcggtgacggcagcccagattcgctcgccagcgtcgt

SEQ ID NO: 204 - DNA, 100 bp, Artificial Sequence
  Primer IL3-2A
tggtctcgtggacgagaagaaaggagcctaccgaacctccatgatctggtacaacgtcctcctggctctcttctctgccctgtccttctacgtgactgcc

SEQ ID NO: 205 - DNA, 100 bp, Artificial Sequence
  Primer IL3-2B
cggtggcagtcacgtagaaggacagggcagagaagagagccaggaggacgttgtaccagatcatggaggttcggtaggctcctttcttctcgtccacgag

SEQ ID NO: 206 - DNA, 100 bp, Artificial Sequence
  Primer IL3-3A
accgctctcggctgggactacggtactggagcctggctgcgaagacagaccggtgatactccccagcctctctttcagtgtccctctcctgtctgggact

SEQ ID NO: 207 - DNA, 100 bp, Artificial Sequence
  Primer IL3-3B
ttggagtcccagacaggagagggacactgaaagagaggctggggagtatcaccggtctgtcttcgcagccaggctccagtaccgtagtcccagccgagag

SEQ ID NO: 208 - DNA, 100 bp, Artificial Sequence
  Primer IL3-4A
ccaagctgttcacctggactgccaaggccttctactattctaagtacgtggagtacctcgacaccgcttggctggtcctcaagggcaagcgagtgtcctt

SEQ ID NO: 209 - DNA, 100 bp, Artificial Sequence
  Primer IL3-4B
cagaaaggacactcgcttgcccttgaggaccagccaagcggtgtcgaggtactccacgtacttagaatagtagaaggccttggcagtccaggtgaacagc

SEQ ID NO: 210 - DNA, 89 bp, Artificial Sequence
  Primer IL3-5A
ttccatcactttggagctccctgggacgtctacctcggcattcgactgcacaacgagggtgtgtggatcttcatgttctttaactcgtt

SEQ ID NO: 211 - DNA, 89 bp, Artificial Sequence
  Primer IL3-5B
aatgaacgagttaaagaacatgaagatccacacaccctcgttgtgcagtcgaatgccgaggtagacgtcccagggagctccaaagtgat

SEQ ID NO: 212 - DNA, 91 bp, Artificial Sequence
  Primer IL3-6A
cattcacaccatcatgtacacctactatggactgactgccgctggctacaagttcaaggccaagcctctgatcactgccatgcagatttgc

SEQ ID NO: 213 - DNA, 91 bp, Artificial Sequence
  Primer IL3-6B
actggcaaatctgcatggcagtgatcagaggcttggccttgaacttgtagccagcggcagtcagtccatagtaggtgtacatgatggtgtg

SEQ ID NO: 214 - DNA, 94 bp, Artificial Sequence
  Primer IL3-7A
cagttcgtcggtggctttctcctggtctgggactacatcaacgttccctgcttcaactctgacaagggcaagctgttctcctgggctttcaact

SEQ ID NO: 215 - DNA, 94 bp, Artificial Sequence
  Primer IL3-7B
gcgtagttgaaagcccaggagaacagcttgcccttgtcagagttgaagcagggaacgttgatgtagtcccagaccaggagaaagccaccgacga

SEQ ID NO: 216 - DNA, 91 bp, Artificial Sequence
  Primer IL3-8A
acgcctacgtcggatctgtctttctcctgttctgtcacttcttttaccaggacaacctggccaccaagaaatccgctaaggctggtaagca

SEQ ID NO: 217 - DNA, 91 bp, Artificial Sequence
  Primer IL3-8B
aagctgcttaccagccttagcggatttcttggtggccaggttgtcctggtaaaagaagtgacagaacaggagaaagacagatccgacgtag

SEQ ID NO: 218 - DNA, 41 bp, Artificial Sequence
  Primer IL3-1F
tttccatggctctggccaacgacgctggcgagcgaatctgg

SEQ ID NO: 219 - DNA, 36 bp, Artificial Sequence
  Primer IL3-4R
tttctgcagaaaggacactcgcttgcccttgaggac

SEQ ID NO: 220 - DNA, 41 bp, Artificial Sequence
  Primer IL3-5F
tttctgcaggccttccatcactttggagctccctgggacgt

SEQ ID NO: 221 - DNA, 42 bp, Artificial Sequence
  Primer IL3-8R
tttgcggccgctaaagctgcttaccagccttagcggatttct

SEQ ID NO: 222 - DNA, 417 bp, Artificial Sequence
  417 bp NcoI/PstI fragment pT9(1-4)
catggctctggccaacgacgctggcgagcgaatctgggctgccgtcaccgatcccgaaatcctcattggcaccttctcctacctgctcctgaagcctctcctgcgaaactctggtctcgtggacgagaagaaaggagcctaccgaacctccatgatctggtacaacgtcctcctggctctcttctctgccctgtccttctacgtgactgccaccgctctcggctgggactacggtactggagcctggctgcgaagacagaccggtgatactccccagcctctctttcagtgtccctctcctgtctgggactccaagctgttcacctggactgccaaggccttctactattctaagtacgtggagtacctcgacaccgcttggctggtcctcaagggcaagcgagtgtcctttctgca

SEQ ID NO: 223 - DNA, 377 bp, Artificial Sequence
  377 bp PstI/Not1 fragment pT9(5-8)
ggccttccatcactttggagctccctgggacgtctacctcggcattcgactgcacaacgagggtgtgtggatcttcatgttctttaactcgttcattcacaccatcatgtacacctactatggactgactgccgctggctacaagttcaaggccaagcctctgatcactgccatgcagatttgccagttcgtcggtggctttctcctggtctgggactacatcaacgttccctgcttcaactctgacaagggcaagctgttctcctgggctttcaactacgcctacgtcggatctgtctttctcctgttctgtcacttcttttaccaggacaacctggccaccaagaaatccgctaaggctggtaagcagctttagc

SEQ ID NO: 224 - DNA, 104 bp, Artificial Sequence
  Primer D8-1A
atggagtccaagcgacaggctctgtctcccctccagctgatggaacagacctacgacgtcgtgaacttccaccctggtggagctgaaatcattgagaactacca

SEQ ID NO: 225 - DNA, 104 bp, Artificial Sequence
  Primer D8-1B
tccctggtagttctcaatgatttcagctccaccagggtggaagttcacgacgtcgtaggtctgttccatcagctggaggggagacagagcctgtcgcttggact

SEQ ID NO: 226 - DNA, 102 bp, Artificial Sequence
  Primer D8-2A
gggacgagatgctactgacgccttcatggttatgcactttcaggaagccttcgacaagctcaagcgaatgcccaagatcaacccctcctttgagctgcctcc

SEQ ID NO: 227 - DNA, 102 bp, Artificial Sequence
  Primer D8-2B
ctggggaggcagctcaaaggaggggttgatcttgggcattcgcttgagcttgtcgaaggcttcctgaaagtgcataaccatgaaggcgtcagtagcatctcg

SEQ ID NO: 228 - DNA, 101 bp, Artificial Sequence
  Primer D8-3A
ccaggctgccgtcaacgaagctcaggaggatttccgaaagctccgagaagagctgatcgccactggcatgtttgacgcctctcccctctggtactcgtaca

SEQ ID NO: 229 - DNA, 101 bp, Artificial Sequence
  Primer D8-3B
atcttgtacgagtaccagaggggagaggcgtcaaacatgccagtggcgatcagctcttctcggagctttcggaaatcctcctgagcttcgttgacggcagc

SEQ ID NO: 230 - DNA, 101 bp, Artificial Sequence
  Primer D8-4A
ccaccaccctgggtcttggcgtgcttggatacttcctgatggtccagtaccagatgtacttcattggtgctgtgctgctcggtatgcactaccagcaaatg

SEQ ID NO: 231 - DNA, 101 bp, Artificial Sequence
  Primer D8-4B
atcccatttgctggtagtgcataccgagcagcacagcaccaatgaagtacatctggtactggaccatcaggaagtatccaagcacgccaagacccagggtg

SEQ ID NO: 232 - DNA, 104 bp, Artificial Sequence
  Primer D8-5A
ggatggctgtctcatgacatctgccaccaccagaccttcaagaaccgaaactggaataacctcgtgggtctggtctttggcaacggactccagggcttctccgt

SEQ ID NO: 233 - DNA, 104 bp, Artificial Sequence
  Primer D8-5B
ggtcacggagaagccctggagtccgttgccaaagaccagacccacgaggttattccagtttcggttcttgaaggtctggtggtggcagatgtcatgagacagcc

SEQ ID NO: 234 - DNA, 101 bp, Artificial Sequence
  Primer D8-6A
gacctgttggaaggacagacacaacgcccatcattctgctaccaacgttcagggtcacgatcccgacattgataacctgcctcccctcgcctggtccgagg

SEQ ID NO: 235 - DNA, 101 bp, Artificial Sequence
  Primer D8-6B
tcgtcctcggaccaggcgaggggaggcaggttatcaatgtcgggatcgtgaccctgaacgttggtagcagaatgatgggcgttgtgtctgtccttccaaca

SEQ ID NO: 236 - DNA, 95 bp, Artificial Sequence
  Primer D8-7A
tcactcgagcttctcccatctcccgaaagctcattcagttccaacagtactatttcctggtcatctgtattctcctgcgattcatctggtgtttc

SEQ ID NO: 237 - DNA, 95 bp, Artificial Sequence
  Primer D8-7B
actggaaacaccagatgaatcgcaggagaatacagatgaccaggaaatagtactgttggaactgaatgagctttcgggagatgggagaagctcga

SEQ ID NO: 238 - DNA, 89 bp, Artificial Sequence
  Primer D8-8A
cagtgcgtgctgaccgttcgatccctcaaggaccgagacaaccagttctaccgatctcagtacaagaaagaggccattggactcgctct

SEQ ID NO: 239 - DNA, 89 bp, Artificial Sequence
  Primer D8-8B
gtgcagagcgagtccaatggcctctttcttgtactgagatcggtagaactggttgtctcggtccttgagggatcgaacggtcagcacgc

SEQ ID NO: 240 - DNA, 85 bp, Artificial Sequence
  Primer D8-9A
gcactggactctcaaggctctgttccacctcttctttatgccctccatcctgacctcgctcctggtgttctttgtttccgagctc

SEQ ID NO: 241 - DNA, 85 bp, Artificial Sequence
  Primer D8-9B
cgacgagctcggaaacaaagaacaccaggagcgaggtcaggatggagggcataaagaagaggtggaacagagccttgagagtcca

SEQ ID NO: 242 - DNA, 91 bp, Artificial Sequence
  Primer D8-10A
gtcggtggcttcggaattgccatcgtggtcttcatgaaccactaccctctggagaagatcggtgatcccgtctgggacggacatggcttct

SEQ ID NO: 243 - DNA, 91 bp, Artificial Sequence
  Primer D8-10B
acagagaagccatgtccgtcccagacgggatcaccgatcttctccagagggtagtggttcatgaagaccacgatggcaattccgaagccac

SEQ ID NO: 244 - DNA, 92 bp, Artificial Sequence
  Primer D8-11A
ctgtgggtcagatccatgagaccatgaacattcgacgaggcatcattactgactggttctttggaggcctgaactaccagatcgagcaccat

SEQ ID NO: 245 - DNA, 92 bp, Artificial Sequence
  Primer D8-11B
agagatggtgctcgatctggtagttcaggcctccaaagaaccagtcagtaatgatgcctcgtcgaatgttcatggtctcatggatctgaccc

SEQ ID NO: 246 - DNA, 93 bp, Artificial Sequence
  Primer D8-12A
ctctggcccactctgcctcgacacaacctcactgccgtttcctaccaggtggaacagctgtgccagaagcacaacctcccctaccgaaaccct

SEQ ID NO: 247 - DNA, 93 bp, Artificial Sequence
  Primer D8-12B
gcagagggtttcggtaggggaggttgtgcttctggcacagctgttccacctggtaggaaacggcagtgaggttgtgtcgaggcagagtgggcc

SEQ ID NO: 248 - DNA, 90 bp, Artificial Sequence
  Primer D8-13A
ctgccccatgaaggtctcgtcatcctgctccgatacctggccgtgttcgctcgaatggccgagaagcagcccgctggcaaggctctctaa

SEQ ID NO: 249 - DNA, 90 bp, Artificial Sequence
  Primer D8-13B
ccgcttagagagccttgccagcgggctgcttctcggccattcgagcgaacacggccaggtatcggagcaggatgacgagaccttcatggg

SEQ ID NO: 250 - DNA, 38 bp, Artificial Sequence
  Primer D8-1F
tttccatggagtccaagcgacaggctctgtctcccctc

SEQ ID NO: 251 - DNA, 37 bp, Artificial Sequence
  Primer D8-3R
tttagatcttgtacgagtaccagaggggagaggcgtc

SEQ ID NO: 252 - DNA, 41 bp, Artificial Sequence
  Primer D8-4F
acaagatctccaccaccctgggtcttggcgtgcttggatac

SEQ ID NO: 253 - DNA, 43 bp, Artificial Sequence
  Primer D8-6R
tttctcgagtgacatcgtcctcggaccaggcgaggggaggcag

SEQ ID NO: 254 - DNA, 32 bp, Artificial Sequence
  Primer D8-7F
tcactcgagcttctcccatctcccgaaagctc

SEQ ID NO: 255 - DNA, 29 bp, Artificial Sequence
  Primer D8-9R
cgacgagctcggaaacaaagaacaccagg

SEQ ID NO: 256 - DNA, 39 bp, Artificial Sequence
  Primer D8-10F
tttgagctcgtcggtggcttcggaattgccatcgtggtc

SEQ ID NO: 257 - DNA, 36 bp, Artificial Sequence
  Primer D8-13R
tttgcggccgcttagagagccttgccagcgggctgc

SEQ ID NO: 258 - DNA, 309 bp, Artificial Sequence
  309 bp NcoI/BglII fragment of pT8(1-3)
catggagtccaagcgacaggctctgtctcccctccagctgatggaacagacctacgacgtcgtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaa

SEQ ID NO: 259 - DNA, 321 bp, Artificial Sequence
  321 bp BglII/XhoI fragment of pT8(4-6)
gatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcac

SEQ ID NO: 260 - DNA, 264 bp, Artificial Sequence
  264 bp XhoI/SacI fragment of pT8(7-9)
tcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagct

SEQ ID NO: 261 - DNA, 369 bp, Artificial Sequence
  369 bp Sac1/Not1 fragment of pT8(10-13)
cgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 262 - DNA, 34 bp, Artificial Sequence
  Primer ODMW390
aagaatcattcaccatgaagtccaagcgacaggc

SEQ ID NO: 263 - DNA, 34 bp, Artificial Sequence
  Primer ODMW391
gcctgtcgcttggacttcatggtgaatgattctt

SEQ ID NO: 264 - DNA, 1852 bp, Artificial Sequence
  chimeric D8S-1::XPR gene
cgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggagtccaagcgacaggctctgtctcccctccagctgatggaacagacctacgacgtcgtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcactcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagctcgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagcggccgccaccgccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcg

SEQ ID NO: 265 - DNA, 1898 bp, Artificial Sequence
  chimeric D8S-2::XPR gene
cgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatgaagtccaagcgacaggctctgtctcccctccagctgatggaacagacctacgacgtcgtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcactcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagctcgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggttaattaa

SEQ ID NO: 266 - DNA, 45 bp, Artificial Sequence
  Primer ODMW392
gaacagacctacgacgtctccgcttgggtgaacttccaccctggt

SEQ ID NO: 267 - DNA, 45 bp, Artificial Sequence
  Primer ODMW393
accagggtggaagttcacccaagcggagacgtcgtaggtctgttc

SEQ ID NO: 268 - DNA, 19 bp, Artificial Sequence
  Primer Eg5-1
gaaatgaagtcaaagcgcc

SEQ ID NO: 269 - DNA, 19 bp, Artificial Sequence
  Primer Eg3-3
ccttatagagccttccccg

SEQ ID NO: 270 - DNA, 22 bp, Artificial Sequence
  Primer T7
gtaatacgactcactatagggc

SEQ ID NO: 271 - DNA, 19 bp, Artificial Sequence
  Primer M13-28Rev
ggaaacagctatgaccatg

SEQ ID NO: 272 - DNA, 19 bp, Artificial Sequence
  Primer Eg3-2
ttggcaatggtctgcaagg

SEQ ID NO: 273 - DNA, 19 bp, Artificial Sequence
  Primer Eg5-2
aatgttcatggtctcatgg

SEQ ID NO: 274 - DNA, 29 bp, Artificial Sequence
  Primer ODMW404
cctggtaccatgaagtccaagcgacaggc

SEQ ID NO: 275 - DNA, 1272 bp, Artificial Sequence
  chimeric gene
catgaagtccaagcgacaggctctgtctcccctccagctgatggaacagacctacgacgtctccgcttgggtgaacttccaccctggtggagctgaaatcattgagaactaccagggacgagatgctactgacgccttcatggttatgcactttcaggaagccttcgacaagctcaagcgaatgcccaagatcaacccctcctttgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctgttggaaggacagacacaacgcccatcattctgctaccaacgttcagggtcacgatcccgacattgataacctgcctcccctcgcctggtccgaggacgatgtcactcgagcttctcccatctcccgaaagctcattcagttccaacagtactatttcctggtcatctgtattctcctgcgattcatctggtgtttccagtgcgtgctgaccgttcgatccctcaaggaccgagacaaccagttctaccgatctcagtacaagaaagaggccattggactcgctctgcactggactctcaaggctctgttccacctcttctttatgccctccatcctgacctcgctcctggtgttctttgtttccgagctcgtcggtggcttcggaattgccatcgtggtcttcatgaaccactaccctctggagaagatcggtgatcccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 276 - DNA, 80 bp, Artificial Sequence
  Primer YL521
tttccatggtgaagtccaagcgacaggctctgcccctcaccatcgacggaactacctacgacgtctccgcttgggtgaac

SEQ ID NO: 277 - DNA, 30 bp, Artificial Sequence
  Primer YL522
tggagatcttgtacgagtaccagaggggag

SEQ ID NO: 278 - DNA, 37 bp, Artificial Sequence
  Primer YL525
ccttcatggttatgcactctcaggaagccttcgacaa

SEQ ID NO: 279 - DNA, 37 bp, Artificial Sequence
  Primer YL526
ttgtcgaaggcttcctgagagtgcataaccatgaagg

SEQ ID NO: 280 - DNA, 38 bp, Artificial Sequence
  Primer YL527
ccaagatcaacccctcctccgagctgcctccccaggct

SEQ ID NO: 281 - DNA, 38 bp, Artificial Sequence
  Primer YL528
agcctggggaggcagctcggaggaggggttgatcttgg

SEQ ID NO: 282 - DNA, 37 bp, Artificial Sequence
  Primer YL529
gggcttctccgtgacctggtggaaggacagacacaac

SEQ ID NO: 283 - DNA, 37 bp, Artificial Sequence
  Primer YL530
gttgtgtctgtccttccaccaggtcacggagaagccc

SEQ ID NO: 284 - DNA, 38 bp, Artificial Sequence
  Primer YL531
acattgataacctgcctctgctcgcctggtccgaggac

SEQ ID NO: 285 - DNA, 38 bp, Artificial Sequence
  Primer YL532
gtcctcggaccaggcgagcagaggcaggttatcaatgt

SEQ ID NO: 286 - DNA, 38 bp, Artificial Sequence
  Primer YL533
tcatctggtgtttccagtctgtgctgaccgttcgatcc

SEQ ID NO: 287 - DNA, 38 bp, Artificial Sequence
  Primer YL534
ggatcgaacggtcagcacagactggaaacaccagatga

SEQ ID NO: 288 - DNA, 39 bp, Artificial Sequence
  Primer YL535
ctgcactggactctcaagaccctgttccacctcttcttt

SEQ ID NO: 289 - DNA, 39 bp, Artificial Sequence
  Primer YL536
aaagaagaggtggaacagggtcttgagagtccagtgcag

SEQ ID NO: 290 - DNA, 37 bp, Artificial Sequence
  Primer YL537
ctggagaagatcggtgattccgtctgggacggacatg

SEQ ID NO: 291 - DNA, 37 bp, Artificial Sequence
  Primer YL538
catgtccgtcccagacggaatcaccgatcttctccag

SEQ ID NO: 292 - DNA, 2987 bp, Yarrowia lipolytica
  misc_feature: mutant acetohydroxyacid synthase (AHAS) with W497L mutation
ttccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctc

SEQ ID NO: 293 - DNA, 39 bp, Artificial Sequence
  SMART IV oligonucleotide
aagcagtggtatcaacgcagagtggccattacggccggg

SEQ ID NO: 294 - DNA, 59 bp, Artificial Sequence
  CDSIII/3'PCR primer
  misc_feature (28)..(57): thymidine (dT); see BD Biosciences Clontech's SMART cDNA technology
  misc_feature (59)..(59): n is a, c, g, or t
attctagaggccgaggcggccgacatgttttttttttttttttttttttttttttttvn

SEQ ID NO: 295 - DNA, 23 bp, Artificial Sequence
  5'-PCR primer
aagcagtggtatcaacgcagagt

SEQ ID NO: 296 - DNA, 18 bp, Artificial Sequence
  Primer M13
tgtaaaacgacggccagt

SEQ ID NO: 297 - DNA, 33 bp, Artificial Sequence
  Primer MLPAT-F
gatcccatggtcgggtccgtcacccgacccaca

SEQ ID NO: 298 - DNA, 34 bp, Artificial Sequence
  Primer MLPAT-R
gatcgcggccgctcacatccagttctctgaccac

SEQ ID NO: 299 - DNA, 32 bp, Artificial Sequence
  Primer LPAT-Re-5-1
gatcgagctcgacattgagcattgatctattt

SEQ ID NO: 300 - DNA, 41 bp, Artificial Sequence
  Primer LPAT-Re-5-2
gactatcgataccatggtcgggcaatgagaacggcagcaag

SEQ ID NO: 301 - DNA, 1129 bp, Yarrowia lipolytica
gatcgagctcgacattgagcattgatctatttgtttagtttagtacgtacgtagagtagttggttattgtatactggatactggtcggatagtcgtgtacaagtacagtatatacttgtagtttggaacactagtcacaagtatagttaataacagtatagtatatacttctactgtacatatagttacaaaacagtacagtatatacttctactgtacatactgtagtttcatggttgatataggtgaaaatgacatggtatcccgcttcccaatgactgatacgagcaacaaacaattctctctaatagatgttcattataaccacactgtacggtaattatatcgtagacagtgtacagtattagaacgtgtttttgatcccaagttggtggaaatgttgagttgagatgagatgataatgttatcagcatgaggggtggatgtatacagtaggagaaggagtatgggcagttgtgcggtagcagcgtctctgaatcacacaaagccgggcttacagcagaggcaagaatggcgccatgtgcctgcgcaatcaagggcgtgaaccacggcttgattccacggcttgatgccacagcttaatgccacatgccacagcataataccacggcatgaccccgctgactccaaccttcatttcggcacgtgtaggtgcacaagggacttcaagaggggccaatttcatgcggacacatggcgcaaaaaacgcccgactttgattacacagacacgtaataacgacgaagccgagatgagcacacgtggccaagtctgccaatggccccctggacccccctgacaaagtttcccaacaagcccagccgtgcatggtgtgtttttgtgcggagacacacgccaattaggctcatttgagggtatgcagcgaaaaaaaattagtgtgggtagtttgtttgcaggaatcaagtgggtggttgaaaaacaagaaagagcgacgacaagagagagagaaaaagagagagagactccataaagcgtgcatcaaaattaaggtgtgtgactatccgaaaaccaaacatgaacagttggatatatgtcgctgtgattgcagttgctgccgttctcattgcccgaccatggatcgatgatc

SEQ ID NO: 302 - DNA, 40 bp, Artificial Sequence
  Primer LPAT-Re-3-1
gactatcgatgcggccgcagactgcagcacaagaagtgct

SEQ ID NO: 303 - DNA, 40 bp, Artificial Sequence
  Primer LPAT-Re-3-2
gatcctcgagtctagagcagggtgttggaggggatggaga

SEQ ID NO: 304 - DNA, 938 bp, Yarrowia lipolytica
gactatcgatgcggccgcagactgcagcacaagaagtgcttgtagctactttaggagagagataggtaatatgaaacatttttcagatcgacacccacggcgaaccattggctgtggagctatgggtgaatggattaatatagcaacgaaatctacctcgattaccaacgcaaaacgagcccactttctctgtactgtgctatatcgtgtataccccagttctcttagatcagtcgtacccgcccgtactgtcatggactattcaaactgttggtttttagtctactcctacttgtaccatgcttatgctcgatgtaccagctacttcgtccgcggacgtgtctctataataaccctgaaagctgctcattcctctaaaagtcgtgacaccacctagtcttactcatcgagattgtattactcatcgagattgtattactcatcgagattgtattactcatcttgattttctctcgtacgatgttgttagtaatcatggccttccagccgaactctaccgaccgaggtaacttcacaaggtttagacagagtccaattattcgaggagcccataagtctacctttacctactctactgtagtgtgaagatgatcatgagaggcatagattggattggacagttggacgggtgacgagggagcagacaagtgcgagattggcgttgttatatggactccagggaccgtgaattgctcttaaactggccgatattagcggctggaaagatccttgtcccactctcttctttgtctatcctggtgatccatttttttgacagctaaaattaactcgccgaaacacgtcggcataccgagattaaattacaaaagaagattaaaacgcgaccagcaaaccgcaacttccgctttactcaacctctccatcccctccaacaccctgctctagactcgaggatc

SEQ ID NO: 305 - DNA, 28 bp, Artificial Sequence
  Primer PZUF-mod1
gatcccatggatccaggcctgttaacgg

SEQ ID NO: 306 - DNA, 32 bp, Artificial Sequence
  Primer PZUF-mod2
gatcgcggccgcagacatgataagatacattg

SEQ ID NO: 307 - DNA, 32 bp, Artificial Sequence
  Primer MACAT-F1
gatcccatggcagagtcgacaacaacgacatg

SEQ ID NO: 308 - DNA, 34 bp, Artificial Sequence
  Primer MACAT-R
gatcgcggccgctcaaacatccatatggcgcttg

SEQ ID NO: 309 - DNA, 28 bp, Artificial Sequence
  Primer MDGAT-F
gatcccatggcgctctttgcgcctttac

SEQ ID NO: 310 - DNA, 35 bp, Artificial Sequence
  Primer MDGAT-R1
gatcgcggccgcctattcgatgatgcacagttcct

SEQ ID NO: 311 - DNA, 20 bp, Artificial Sequence
  Primer MGPAT-N1
  misc_feature (3)..(3): n is a, c, g, or t
  misc_feature (9)..(9): n is a, c, g, or t
ccncaygcnaaycarttygt

SEQ ID NO: 312 - DNA, 20 bp, Artificial Sequence
  Primer MGPAT-NR5
  misc_feature (6)..(6): n is a, c, g, or t
  misc_feature (9)..(9): n is a, c, g, or t
  misc_feature (15)..(15): n is a, c, g, or t
ttccangtngccatntcrtc

SEQ ID NO: 313 - DNA, 22 bp, Artificial Sequence
  Primer MGPAT-5N1
catctctcggctgatccagatg

SEQ ID NO: 314 - DNA, 21 bp, Artificial Sequence
  Primer MGPAT-5N2
ttgtctggcgctacctggaac

SEQ ID NO: 315 - DNA, 22 bp, Artificial Sequence
  Primer MGPAT-5N3
cattgtcgctcgtgtcatcagc

SEQ ID NO: 316 - DNA, 44 bp, Artificial Sequence
  Genome Walker adaptor-1
gtaatacgactatagggcacgcgtggtcgacggcccgggctggt

SEQ ID NO: 317 - DNA, 8 bp, Artificial Sequence
  Genome Walker adaptor-2
  misc_feature (1)..(1): 5' end is associated with a -PO4 group
  misc_feature (8)..(8): 3' end is associated with a -H2N group
accagccc

SEQ ID NO: 318 - DNA, 22 bp, Artificial Sequence
  Primer MGPAT-5-1A
cagctcctttgtgaatttagtg

SEQ ID NO: 319 - DNA, 22 bp, Artificial Sequence
  Primer AP1
gtaatacgactcactatagggc

SEQ ID NO: 320 - DNA, 23 bp, Artificial Sequence
  Primer MGPAT-3N1
cataacgatccagaagtttgatg

SEQ ID NO: 321 - DNA, 19 bp, Artificial Sequence
  Primer AP2
actatagggcacgcgtggt

SEQ ID NO: 322 - DNA, 32 bp, Artificial Sequence
  Primer mgpat-cdna-5
gatcggatcctcagatctacgactttgtgtcg

SEQ ID NO: 323 - DNA, 33 bp, Artificial Sequence
  Primer MGPAT-cDNA-R
gatcgcggccgcctaaatgtcttttgacttggc

SEQ ID NO: 324 - DNA, 25 bp, Artificial Sequence
  Primer MA Elong 3'1
gatacggatcagagcctgtggaaca

SEQ ID NO: 325 - DNA, 25 bp, Artificial Sequence
  Primer MA elong 3'2
cttctacctttcaaagttttacgag

SEQ ID NO: 326 - DNA, 25 bp, Artificial Sequence
  Primer MA Elong 5'1
gcataggtccagactccattatgcg

SEQ ID NO: 327 - DNA, 25 bp, Artificial Sequence
  Primer MA Elong 5'2
cagaggaatataggtcggcaccaaa

SEQ ID NO: 328 - DNA, 24 bp, Artificial Sequence
  Primer MA ELONG 5' NcoI 3
gatcccatggagtctggacctatg

SEQ ID NO: 329 - DNA, 30 bp, Artificial Sequence
  Primer MA ELONG 3' NotI 1
gatcgcggccgcttactgggccttcttctg

SEQ ID NO: 330 - DNA, 28 bp, Artificial Sequence
  Primer YL597
tttccatggtctcgtcaatctcgccgac

SEQ ID NO: 331 - DNA, 33 bp, Artificial Sequence
  Primer YL598
tttgcggccgcttagatggacttggccttcaag

SEQ ID NO: 332 - DNA, 36 bp, Artificial Sequence
  Primer YL567
tttccatggctgccgtccctattgaattcaacgtcc

SEQ ID NO: 333 - DNA, 24 bp, Artificial Sequence
  Primer YL568
gatcagctcaaagtacttggtcag

SEQ ID NO: 334 - DNA, 24 bp, Artificial Sequence
  Primer YL569
ctgaccaagtactttgagctgatc

SEQ ID NO: 335 - DNA, 36 bp, Artificial Sequence
  Primer YL570
tttgcggccgcttatgctcgtcgagatcgggtagtg

SEQ ID NO: 336 - DNA, 36 bp, Artificial Sequence
  Primer YL571
tcctccacacctaccatcacggtgccactgctcttc

SEQ ID NO: 337 - DNA, 36 bp, Artificial Sequence
  Primer YL572
gaagagcagtggcaccgtgatggtaggtgtggagga

SEQ ID NO: 338 - DNA, 28 bp, Artificial Sequence
  Primer CPT1-5'-NcoI
acgtccatgggcgtattcattaaacagg

SEQ ID NO: 339 - DNA, 33 bp, Artificial Sequence
  Primer CPT1-3'-NotI
acgtgcggccgcttattcggtcttcttctcctg

SEQ ID NO: 340 - DNA, 30 bp, Artificial Sequence
  Primer Isc1F
ataccatggacaacagaaaagacagagatg

SEQ ID NO: 341 - DNA, 31 bp, Artificial Sequence
  Primer Isc1R
tgcggccgctcatttctcgctcaagaaagtt

SEQ ID NO: 342 - DNA, 30 bp, Artificial Sequence
  Primer Pcl1F
ataccatgggtgaatacagcaaaggctctt

SEQ ID NO: 343 - DNA, 33 bp, Artificial Sequence
  Primer Pcl1R
tgcggccgcttaaaacccatgttgactcatgat

SEQ ID NO: 344 - DNA, 29 bp, Artificial Sequence
  Primer P95
ggcaagcttattgtcgttggtggagcaca

SEQ ID NO: 345 - DNA, 35 bp, Artificial Sequence
  Primer P96
aattccaccagatctgtcgtggtattcggacactt

SEQ ID NO: 346 - DNA, 39 bp, Artificial Sequence
  Primer P97
ataccacgacagatctggtggaattgccaccgagggagc

SEQ ID NO: 347 - DNA, 30 bp, Artificial Sequence
  Primer P98
gcggaattcgcagatagactggtttcgctt

SEQ ID NO: 348 - DNA, 22 bp, Artificial Sequence
  Primer P115
aactacatcttcggctatcacc

SEQ ID NO: 349 - DNA, 22 bp, Artificial Sequence
  Primer P116
tgaacaagcgtagattccagac

SEQ ID NO: 350 - DNA, 22 bp, Artificial Sequence
  Primer P112
cacccttgctcggcgatgtatc

SEQ ID NO: 351 - DNA, 34 bp, Artificial Sequence
  Primer P39
ggcggtaccggatcctcaatcgaagagactaagc

SEQ ID NO: 352 - DNA, 41 bp, Artificial Sequence
  Primer P41
cttctgtattctagatctcaagatcgagaagcaccagaaaa

SEQ ID NO: 353 - DNA, 48 bp, Artificial Sequence
  Primer P40
gcttctcgatcttgagatctagaatacagaagtcaacggttcatccat

SEQ ID NO: 354 - DNA, 30 bp, Artificial Sequence
  Primer P42
ccggaattcagctttgagcttggagaagta

SEQ ID NO: 355 - DNA, 22 bp, Artificial Sequence
  Primer P51
tagatagactggactatacggc

SEQ ID NO: 356 - DNA, 20 bp, Artificial Sequence
  Primer P52
gactgtcctaccctgatttg

SEQ ID NO: 357 - DNA, 33 bp, Artificial Sequence
  Primer P37
ccaggtaccaagatcgagaagcaccagaaaagc

SEQ ID NO: 358 - DNA, 36 bp, Artificial Sequence
  Primer P38
ctcgaattcagaatacagaagtcaacggttcatcca

SEQ ID NO: 359 - DNA, 41 bp, Artificial Sequence
  Primer P201
ctcgcggccgccatggaggtccgacgacgaaarathgaygt

SEQ ID NO: 360 - DNA, 46 bp, Artificial Sequence
  Primer P203
  misc_feature (38)..(38): n is a, c, g, or t
gaggcggccgctactggttctgcttgtagttgtaggcnarrtarta

SEQ ID NO: 361 - DNA, 44 bp, Artificial Sequence
  Primer P214
atctcgacaatcgtcgcagccctcctcaagagcatcgtccagaa

SEQ ID NO: 362 - DNA, 42 bp, Artificial Sequence
  Primer P215
cgaacagatcccaatattacatgaggcgagtttgagagacag

SEQ ID NO: 363 - DNA, 44 bp, Artificial Sequence
  Primer P216
aactggtatttaaatgatgtccccaagacggagcgtattcgacc

SEQ ID NO: 364 - DNA, 40 bp, Artificial Sequence
  Primer P217
gtagttgtaggctaggtagtaaaggaatgcacaagtgggt

SEQ ID NO: 365 - DNA, 40 bp, Artificial Sequence
  Primer P219
cgaatacgctccgtcttggggacatcatttaaataccagt

SEQ ID NO: 366 - DNA, 20 bp, Artificial Sequence
  Primer P226
cgacgaaaaattgacgtgct

SEQ ID NO: 367 - DNA, 20 bp, Artificial Sequence
  Primer P227
gatttccgaacagatcccaa

SEQ ID NO: 368 - DNA, 10 bp, Yarrowia lipolytica
  misc_feature (8)..(8): n is a, c, g, or t
mammatgnhs

SEQ ID NO: 369 - DNA, 1590 bp, Danio rerio (GenBank Accession No. AF309556)
  CDS (1)..(1335)
  misc_feature (1)..(1335): Drd6/d5(V)
atgggtggcggaggacagcagacagaccgaatcaccgacaccaacggcagattcagcagctacacctgggaggaggtgcagaaacacaccaaacatggagatcagtgggtggtggtggagaggaaggtttataacgtcagccagtgggtgaagagacaccccggaggactgaggatcctcggacactatgctggagaagacgccacggaggcgttcactgcgtttcatccaaaccttcagctggtgaggaaatacctgaagccgctgctaatcggagagctggaggcgtctgaacccagtcaggaccggcagaaaaacgctgctctcgtggaggatttccgagccctgcgtgagcgtctggaggctgaaggctgttttaaaacgcagccgctgtttttcgctctgcatttgggccacattctgctcctggaggccatcgctttcatgatggtgtggtatttcggcaccggttggatcaacacgctcatcgtcgctgttattctggctactgcacagtcacaagctggatggttgcagcatgacttcggtcatctgtccgtgtttaaaacctctggaatgaatcatttggtgcacaaatttgtcatcggacacctgaagggagcgtctgcgggctggtggaaccatcggcacttccagcatcacgctaaacccaacatcttcaagaaggacccggacgtcaacatgctgaacgcctttgtggtgggaaacgtgcagcccgtggagtatggcgttaagaagatcaagcatctgccctacaaccatcagcacaagtacttcttcttcattggtcctcccctgctcatcccagtgtatttccagttccaaatctttcacaatatgatcagtcatggcatgtgggtggacctgctgtggtgtatcagctactacgtccgatacttcctttgttacacgcagttctacggcgtcttttgggctattatcctctttaatttcgtcaggtttatggagagccactggtttgtttgggtcacacagatgagccacatccccatgaacattgactatgagaaaaatcaggactggctcagcatgcagctggtcgcgacctgtaacatcgagcagtctgccttcaacgactggttcagcggacacctcaacttccagatcgagcatcatctctttcccacagtgcctcggcacaactactggcgcgccgctccacgggtgcgagcgttgtgtgagaaatacggagtcaaataccaagagaagaccttgtacggagcatttgcggatatcattaggtctttggagaaatctggcgagctctggctggatgcgtatctcaacaaataaagcatgacttctccctaaatagaaaaaaagcggagccgaatcctccaatcagagcgagccttcacagactagacatcaggaagaatcgcgactaaacccccagtcaatcagttcagtaaaatgacgcgtagcactttgttttttgatatctgcaagataattgtggcactttgaatgcgttttaaagagacggctcaaagatgtgtgtctcgctcctaataaaggaagaatctgaaaggaaaaaaaaaaaaaaaa

SEQ ID NO: 370 - protein, 444 aa, Danio rerio (GenBank Accession No. AF309556)
MGGGGQQTDRITDTNGRFSSYTWEEVQKHTKHGDQWVVVERKVYNVSQWVKRHPGGLRILGHYAGEDATEAFTAFHPNLQLVRKYLKPLLIGELEASEPSQDRQKNAALVEDFRALRERLEAEGCFKTQPLFFALHLGHILLLEAIAFMMVWYFGTGWINTLIVAVILATAQSQAGWLQHDFGHLSVFKTSGMNHLVHKFVIGHLKGASAGWWNHRHFQHHAKPNIFKKDPDVNMLNAFVVGNVQPVEYGVKKIKHLPYNHQHKYFFFIGPPLLIPVYFQFQIFHNMISHGMWVDLLWCISYYVRYFLCYTQFYGVFWAIILFNFVRFMESHWFVWVTQMSHIPMNIDYEKNQDWLSMQLVATCNIEQSAFNDWFSGHLNFQIEHHLFPTVPRHNYWRAAPRVRALCEKYGVKYQEKTLYGAFADIIRSLEKSGELWLDAYLNK

SEQ ID NO: 371 - DNA, 1946 bp, Danio rerio (GenBank Accession No. BC068224)
cacaacagtactgtatgagtgtgtgatcaaagtgcctgctgagacgtgatacgcgagcagcactgttcagagatcagcgatgggtggcggaggacagcagacagaccgaatcaccgacaccaacggcagattcagcagctacacctgggaggaggtgcagaaacacaccaaacatggagatcagtgggtggtggtggagaggaaggtttataacgtcagccagtgggtgaagagacaccccggaggactgaggatcctcggacactatgctggagaagacgccacggaggcgttcactgcgtttcatccaaaccttcagctggtgaggaaatacctgaagccgctgctaatcggagagctggaggcgtctgaacccagtcaggaccggcagaaaaacgctgctctcgtggaggatttccgagccctgcgtgagcgtctggaggctgaaggctgttttaaaacgcagccgctgtttttcgctctgcatttgggccacattctgctcctggaggccatcgctttcatgatggtgtggtatttcggcaccggttggatcaacacgctcatcgtcgctgttattctggctactgcacagtcacaagctggatggttgcagcatgacttcggtcatctgtccgtgtttaaaacctctggaatgaatcatttggtgcacaaatttgtcatcggacacctgaagggagcgtctgcgggctggtggaaccatcggcacttccagcatcacgctaaacccaacatcttcaagaaggacccggacgtcaacatgctgaacgcctttgtggtgggaaacgtgcagcccgtggagtatggcgttaagaagatcaagcatctgccctacaaccatcagcacaagtacttcttcttcattggtcctcccctgctcatcccagtgtatttccagttccaaatctttcacaatatgatcagtcatggcatgtgggtggacctgctgtggtgtatcagctactacgtccgatacttcctttgttacacgcagttctacggcgtcttttgggctattatcctctttaatttcgtcaggttatggagagccactggtttgtttgggtcacacagatgagccacatccccatgaacattgactatgagaaaaatcaggactggctcagcatgcagctggtcgcgacctgtaacatcgagcagtctgccttcaacgactggttcagcggacacctcaacttccagatcgagcatcatctctttcccacaatgcctcggcacaactactggcgcgccgctccacgggtgcgagcgttgtgtgagaaatacggagtcaaataccaagagaagaccttgtacggagcatttgcggatatcattaggtctttggagaaatctggcgagctctggctggatgcgtatctcaacaaataaagcatgacttctccctaaatagaaaaaaagcggagccgaatcctccaatcagagcgagccttcacagactagacatcaggaagaatcgcaactaaacccccagtcaatcagttcagtaaaatgacgcgtagcactttgttttttgatatctgcaagataattgtggcactttgaatgcgttttaaagagacggctcaaagatgtgtgtctcgctcctaataaaggaaaaatctgaaagtacatgtacgtgcatgaatgtgtgtgaaagttgtgattgctggtttacaatcgccgagtttgctaggtaatttcgaagtttttatttagtaaatttgcaattcagatgttgtttttataactaacattcggacaaatgagatgacgataacactagtggttgcactttgtggtttattatgaaatttaattggatttcctactattggtcatcgattaaacggattaaacctcaaaaaaaaaaaaaaaaaaaaaaaaaaaaaaaaaaaaaaaaaaaaaaaaaaaaaaaaaaaaaa

SEQ ID NO: 372 - DNA, 1335 bp, Danio rerio
  misc_feature: Drd6/d5(M)
atgggtggcggaggacagcagacagaccgaatcaccgacaccaacggcagattcagcagctacacctgggaggaggtgcagaaacacaccaaacatggagatcagtgggtggtggtggagaggaaggtttataacgtcagccagtgggtgaagagacaccccggaggactgaggatcctcggacactatgctggagaagacgccacggaggcgttcactgcgtttcatccaaaccttcagctggtgaggaaatacctgaagccgctgctaatcggagagctggaggcgtctgaacccagtcaggaccggcagaaaaacgctgctctcgtggaggatttccgagccctgcgtgagcgtctggaggctgaaggctgttttaaaacgcagccgctgtttttcgctctgcatttgggccacattctgctcctggaggccatcgctttcatgatggtgtggtatttcggcaccggttggatcaacacgctcatcgtcgctgttattctggctactgcacagtcacaagctggatggttgcagcatgacttcggtcatctgtccgtgtttaaaacctctggaatgaatcatttggtgcacaaatttgtcatcggacacctgaagggagcgtctgcgggctggtggaaccatcggcacttccagcatcacgctaaacccaacatcttcaagaaggacccggacgtcaacatgctgaacgcctttgtggtgggaaacgtgcagcccgtggagtatggcgttaagaagatcaagcatctgccctacaaccatcagcacaagtacttcttcttcattggtcctcccctgctcatcccagtgtatttccagttccaaatctttcacaatatgatcagtcatggcatgtgggtggacctgctgtggtgtatcagctactacgtccgatacttcctttgttacacgcagttctacggcgtcttttgggctattatcctctttaatttcgtcaggtttatggagagccactggtttgtttgggtcacacagatgagccacatccccatgaacattgactatgagaaaaatcaggactggctcagcatgcagctggtcgcgacctgtaacatcgagcagtctgccttcaacgactggttcagcggacacctcaacttccagatcgagcatcatctctttcccacaatgcctcggcacaactactggcgcgccgctccacgggtgcgagcgttgtgtgagaaatacggagtcaaataccaagagaagaccttgtacggagcatttgcggatatcattaggtctttggagaaatctggcgagctctggctggatgcgtatctcaacaaataa

SEQ ID NO: 373 - protein, 444 aa, Danio rerio
  MISC_FEATURE: Drd6/d5(M)
MGGGGQQTDRITDTNGRFSSYTWEEVQKHTKHGDQWVVVERKVYNVSQWVKRHPGGLRILGHYAGEDATEAFTAFHPNLQLVRKYLKPLLIGELEASEPSQDRQKNAALVEDFRALRERLEAEGCFKTQPLFFALHLGHILLLEAIAFMMVWYFGTGWINTLIVAVILATAQSQAGWLQHDFGHLSVFKTSGMNHLVHKFVIGHLKGASAGWWNHRHFQHHAKPNIFKKDPDVNMLNAFVVGNVQPVEYGVKKIKHLPYNHQHKYFFFIGPPLLIPVYFQFQIFHNMISHGMWVDLLWCISYYVRYFLCYTQFYGVFWAIILFNFVRFMESHWFVWVTQMSHIPMNIDYEKNQDWLSMQLVATCNIEQSAFNDWFSGHLNFQIEHHLFPTMPRHNYWRAAPRVRALCEKYGVKYQEKTLYGAFADIIRSLEKSGELWLDAYLNK

SEQ ID NO: 374 - DNA, 1403 bp, Mortierella alpina (GenBank Accession No. AB020033)
  misc_feature: delta-12 desaturase
ctcctcccaccaccctccgagacgactgcaactgtaatcaggaaccgaaaaatatacgatttctttttactcagcaccaactcaaaatcttcagcagcaaccctttttcaggatggcacctcccaacactattgatgccggtttgacccagcgccatatcagcacctcggccgccccaacctctgccaagcccgccttcgagcgcaactaccagctccctgagttcaccatcaaggagatccgtgagtgcatccctgcacactgctttgagcgctccggtctccgtggtctttgccacgttgctattgatctgacctgggcctcgctcttgttcctggctgcgacccagatcgacaagttcgagaaccctttgatccgctacttggcctggcctgcgtattggatcatgcagggtattgtttgcaccggtatctgggtattggcacacgaatgtggtcatcagtccttctcgacctccaagacccttaacaacactgtcggctggatcttgcactcgatgctcttggtcccttaccactcctggagaatctcgcactcgaagcaccacaaggccactggccacatgaccaaggaccaggtctttgttcccaagacccgctctcaggttggcttgccccccaaggagaatgttgcagttgccgttcaggaggaggatatgtccgtgcacctggatgaggaggcccccattgtgactttgttctggatggtgattcagttcctgttcggatggcctgcgtaccttattatgaacgcctctggtcaagactatggccgctggacctcgcacttccacacctactctcctatctttgagccccgcaactttttcgacattatcatttcggatctcggtgtgttggctgctcttggtaccttgatctacgcctccatgcagctctcgctcttgaccgtgaccaagtactacattgtcccctacttgtttgtcaacttctggttggtcctgatcaccttcttgcagcacaccgaccctaagctgccccattaccgtgagggtgcctggaacttccagcgtggagccctctgcaccgttgaccgctcgttcggcaagttcttggaccatatgttccacggcattgtccatacccatgtagcccatcacttgttctcgcagatgccgttctaccatgctgaggaagccacccatcatctcaagaaactgctgggagagtactacgtctatgacccatcgccgattgttgttgcggtctggaggtcgttccgtgaatgccgattcgtggaagaccatggagacgtggtctttttcaagaagtaaagaagcatttaccggacacaactttgtctttacacgcctacgtactgagtagccatcccactttataaaagatttcagttccagcagc

SEQ ID NO: 375 - protein, 400 aa, Mortierella alpina (GenBank Accession No. AB020033)
  MISC_FEATURE: delta-12 desaturase
MAPPNTIDAGLTQRHISTSAAPTSAKPAFERNYQLPEFTIKEIRECIPAHCFERSGLRGLCHVAIDLTWASLLFLAATQIDKFENPLIRYLAWPAYWIMQGIVCTGIWVLAHECGHQSFSTSKTLNNTVGWILHSMLLVPYHSWRISHSKHHKATGHMTKDQVFVPKTRSQVGLPPKENVAVAVQEEDMSVHLDEEAPIVTLFWMVIQFLFGWPAYLIMNASGQDYGRWTSHFHTYSPIFEPRNFFDIIISDLGVLAALGTLIYASMQLSLLTVTKYYIVPYLFVNFWLVLITFLQHTDPKLPHYREGAWNFQRGALCTVDRSFGKFLDHMFHGIVHTHVAHHLFSQMPFYHAEEATHHLKKLLGEYYVYDPSPIVVAVWRSFRECRFVEDHGDVVFFKK

SEQ ID NO: 376 - protein, 416 aa, Saccharomyces kluyveri (GenBank Accession No. BAD08375)
  MISC_FEATURE: delta-12 desaturase
MSAVTVTGSDPKNRGSSSNTEQEVPKVAIDTNGNVFSVPDFTIKDILGAIPHECYERRLATSLYYVFRDIFCMLTTGYLTHKILYPLLISYTSNSIIKFTFWALYTYVQGLFGTGIWVLAHECGHQAFSDYGIVNDFVGWTLHSYLMVPYFSWKYSHGKHHKATGHMTRDMVFVPATKEEFKKSRNFFGNLAEYSEDSPLRTLYELLVQQLGGWIAYLFVNVTGQPYPDVPSWKWNHFWLTSPLFEQRDALYIFLSDLGILTQGIVLTLWYKKFGGWSLFINWFVPYIWVNHWLVFITFLQHTDPTMPHYNAEEWTFAKGAAATIDRKFGFIGPHIFHDIIETHVLHHYCSRIPFYNARPASEAIKKVMGKHYRSSDENMWKSLWKSFRSCQYVDGDNGVLMFRNINNCGVGAAEK

SEQ ID NO: 377 - DNA, 1948 bp, Kluyveromyces lactis (gnl|GLV|KLLA0B00473g)
  misc_feature: delta-12 desaturase
gaaaaaaaacaaacacagtctcgaagaagattcagacaaacagtagcacaagactattttctacaccgacgaatgttcgtactaccgcgttacttggcgaacaccgcccatgcttaatgtgaaaaagcacacacattgatgcgtgtagctagaccaattgcaacccattagatttactgcagaaagaggaaaagtgctactttttttcagtcaatggtatcacaattggcgatgagccttgacgaaaggaagcagcgataaaaagaaaatggattaaaaaaaatgtcctgcttagttatgggcaattgatagttttacttcaaatatcgtttgaagatttccgttcagtcagtttccattcacatttggcttcagcttatataaatataatatataaagaattttatgatcatgatatatgatcattactttacctaagtggaagattaagtggtagttgtacatcatatacacccgcagaacgtagctagacagacccaatgagcaaaagcaccggcgtcgagcatcatatcagtggtgttgctactacagaaacggcaacagagacagttactgttcctcctgccaagacagctattgacacacatggtaacatcttcaaggttccagactatactatcaaagacatcctaggtgccatcccaaaggagtgttacaagagagacactctttggtcattgcattatgtggtaagagatattattgccatctgtattattgggtatgttggtaccaactacattccagtttggtttccaaatagtggtctcctaagatttgttgcctatatggtgcaatcatacttaattgggttatttggttttgggttgtggattttggctcacgaatgcggtcatggtgccttctctgattcaagattaatcaacgataccgttgggtgggttttgcactcatggtggatggtcccatacttttcttggaaattctctcactctaagcatcataaagctaccggtcatttgactagagatatggtttttgttccatacacgaaaaaagaatacttggaaatgaagggtaaatcaaaactaagggagatcaccgaagaagcaccaattgtaactttattaactttgattggccaacaaattggtggtttgcagttgtatttagcaacaaatgccactggccaatcttatcctggtgttcctaaattcttcaaatcccattactggcctacttctccggtgttcgataccaaggacttctggtacatcattctgagtgacattggtattatttccacacttacaatcaattatttgtgggcaaagacctatggctcccatgtcatgttgatcaactggtttgttccatggttatgggttaaccactggttagtatttgtcacatttttgcaacacactgacccaaccatgcctcattacgaagccagtgaatggaccttcgctaaaggtgctgctgccaccattgatagaaactttggctttgttggtcaacatattttccacgatattattgaaacgcatgttttgcatcattactgttcaagaattcctttctacaacgctcgtgtagccactgaagctattaagaaagttatgggtgaacattatcgttatgaaggcgaaaatatgtggcaatcattatggaaggtggcaagatcctgtcagtttgtagatggtgacaacggtgttttgatgttcagaaacacaaacggagtcggagcaccatgtcaagaatgagtgcacatagagtatcaatttttcattcatcaagttcattcccttatcattatcattcttattattatttatcttaactgtacattaaaattttacccgatgcaaaatatcaaccgaatgtgcttatgccacgtcggttaattggaaaatattaatcttaccagtcaaattgctttactctcaaaatttttgataggagt

SEQ ID NO: 378 - protein, 415 aa, Kluyveromyces lactis (gnl|GLV|KLLA0B00473g)
  MISC_FEATURE: delta-12 desaturase
MSKSTGVEHHISGVATTETATETVTVPPAKTAIDTHGNIFKVPDYTIKDILGAIPKECYKRDTLWSLHYVVRDIIAICIIGYVGTNYIPVWFPNSGLLRFVAYMVQSYLIGLFGFGLWILAHECGHGAFSDSRLINDTVGWVLHSWWMVPYFSWKFSHSKHHKATGHLTRDMVFVPYTKKEYLEMKGKSKLREITEEAPIVTLLTLIGQQIGGLQLYLATNATGQSYPGVPKFFKSHYWPTSPVFDTKDFWYIILSDIGIISTLTINYLWAKTYGSHVMLINWFVPWLWVNHWLVFVTFLQHTDPTMPHYEASEWTFAKGAAATIDRNFGFVGQHIFHDIIETHVLHHYCSRIPFYNARVATEAIKKVMGEHYRYEGENMWQSLWKVARSCQFVDGDNGVLMFRNTNGVGAPCQE

SEQ ID NO: 379 - protein, 436 aa, Candida albicans SC5314 (GenBank Accession No. EAK94955)
  MISC_FEATURE: delta-12 desaturase
MAAATTSFSSGFNNNNNADQSTDSSATISKSGNVASFKTTSTTSTYQTNLTAIDTYGNEFKVPDYTIKDILSAIPTHCYERRLLQSLSYVFRDIFCMVVLGFIANNYIHLIPNQFIRFAAWTGYVWCQGLFGTGIWVLAHECGHQAFSDYGSVNDFVGWVLHSYLLVPYFSWKFSHGKHHKATGHLTRDMVFVPKTKEEFLQNRGVKDLDDLLGDSPMYSLLTLIFQQTFGWISYLVANVSGQKYPGVSFLKLNHFNPNSLIFDKKDYWYILLSDLGILLQFFNLYVWYQSFGGFNLLVNYVLPYFLVNHWLVFITYLQHSDPQMPHYEASQWTFARGAAATIDREFGFVGKHIFHDIIETHVLHHYVSRIPFYNAREASEAIKKVMGIHYQHSDENMWVSLWKSARWCQFVDGNNGVLMYRNTNGFGVDPKKQTH

SEQ ID NO: 380 - protein, 416 aa, Debaryomyces hansenii CBS767 (GenBank Accession No. CAG90237)
  MISC_FEATURE: delta-12 desaturase
MASQIASSTKSSGIGGSSSIQKRGNVATLQTNENLTAIDAHGNVFKVPDYTIKDILKAIPAHCYERRVAESMYYVFRDIFWLLTIGYVANNYIQLLPNAFTRFVAWSGYVYVQSLFLTGLWVLAHECGHQAFSDYGWVNDTVGWVLHSYLMVPYFSWKFSHSKHHKATGHLTRDMVFVPYTKEEFVASKNAHHIDDIVGDSPIYTLYQLVVQQFGGWIAYLFTNVTGQQYENKSFWGVSHFNPNAAIFEKKEQWYVLLSDIGIFAQGLVLHTWYKNFGGFNLLVNWFLPYILVNHWLVFITYLQHTDSQMPHYESHQWNFARGAAATIDREFGFVGKFMFHDIIETHVLHHYCSRIPFYNGREASEAIKKVMGEHYQYSDENMWVSLWKSARTCQYVDGDNGVLMFRNAAFKGPKA

SEQ ID NO: 381 - DNA, 1353 bp, Mortierella alpina (GenBank Accession No. AB182163)
  misc_feature: delta-15 desaturase
atggccccccctcacgttgtcgacgaacaagttcgacgcaggatcgtcgttgaggacgagatcaagtctaagaagcaatttgagcgcaactatgtgcccatggactttacgattaaggagattcgagatgcgatccctgcccacctcttcatccgtgataccacaaagtcgatcctgcatgtcgtcaaggatctggtcaccatcgccatcgtcttttactgtgcaaccttcattgagactctgccctcgctcgctctgcgagttcctgcctggatcacctactggatcatccaaggaactgtcatggtcggcccctggatcttggctcatggtaaggaaacgaaaaatcccatgtgtatttctgtactacagaaggcgaagtttgtacctgaaaagatcagcgtcgtcccttgatttagaatgtaactaaccttgcaatcgtatgacctaaattttcttgtgtcaacgacagagtgcggccacggagctttctcggatagcaagacgatcaacaccatctttggatgggtcctccactctgctcttttggtgccctaccaggcctgggctatgtcacactccaagcatcacaagggtactggatcgatgaccaaagatgtcgttttcatccctgccactcgttcctacaagggcctcccagcactggagaagcctgccgtcgaagaggaggtttcggagcaggaacaccaccaccacgaggagtccatctttgccgaaactcccatctacacgctcggagcgcttttgttcgtcttgaccttcggatggcccttgtacttgatcgtcaacttttcaggacacgaggcccctcactgggtcaaccatttccagactgtcgctcctctctatgagcctcaccagcgcaagaacatcttctactccaactgcggcattgtcgccatgggttcgatcttgacttacctttcgatggtcttctcgcccttgactgtcttcatgtactatggcatcccttacctcggagtcaacgcctggatcgtctgcattacctatctccagcacaccgatcccaaggtgcctcacttccgtgataacgagtggaacttccagcgcggtgctgcctgcactatcgaccgatccttcggtaccatcgtgaaccacctgcaccaccacattggcgactctcaccagtgccaccatatgttctcgcagatgcccttctacaatgctgtggaggctacaaagtacttgaaggccaaacttggcaagtactacatatttgacgacacgcccattgccaaagccctctaccgcaattggagagagtgcaaattcgtggaggacgagggagatgtagtgttttacaagcattaa

SEQ ID NO: 382 - protein, 403 aa, Mortierella alpina (GenBank Accession No. AB182163)
  MISC_FEATURE: delta-15 desaturase
MAPPHVVDEQVRRRIVVEDEIKSKKQFERNYVPMDFTIKEIRDAIPAHLFIRDTTKSILHVVKDLVTIAIVFYCATFIETLPSLALRVPAWITYWIIQGTVMVGPWILAHECGHGAFSDSKTINTIFGWVLHSALLVPYQAWAMSHSKHHKGTGSMTKDVVFIPATRSYKGLPALEKPAVEEEVSEQEHHHHEESIFAETPIYTLGALLFVLTFGWPLYLIVNFSGHEAPHWVNHFQTVAPLYEPHQRKNIFYSNCGIVAMGSILTYLSMVFSPLTVFMYYGIPYLGVNAWIVCITYLQHTDPKVPHFRDNEWNFQRGAACTIDRSFGTIVNHLHHHIGDSHQCHHMFSQMPFYNAVEATKYLKAKLGKYYIFDDTPIAKALYRNWRECKFVEDEGDVVFYKH

SEQ ID NO: 383 - DNA, 1248 bp, Kluyveromyces lactis (GenBank Accession No. XM_451551)
  misc_feature: delta-15 desaturase
atgagcaaaagcaccggcgtcgagcatcatatcagtggtgttgctactacagaaacggcaacagagacagttactgttcctcctgccaagacagctattgacacacatggtaacatcttcaaggttccagactatactatcaaagacatcctaggtgccatcccaaaggagtgttacaagagagacactctttggtcattgcattatgtggtaagagatattattgccatctgtattattgggtatgttggtaccaactacattccagtttggtttccaaatagtggtctcctaagatttgttgcctatatggtgcaatcatacttaattgggttatttggttttgggttgtggattttggctcacgaatgcggtcatggtgccttctctgattcaagattaatcaacgataccgttgggtgggttttgcactcatggtggatggtcccatacttttcttggaaattctctcactctaagcatcataaagctaccggtcatttgactagagatatggtttttgttccatacacgaaaaaagaatacttggaaatgaagggtaaatcaaaactaagggagatcaccgaagaagcaccaattgtaactttattaactttgattggccaacaaattggtggtttgcagttgtatttagcaacaaatgccactggccaatcttatcctggtgttcctaaattcttcaaatcccattactggcctacttctccggtgttcgataccaaggacttctggtacatcattctgagtgacattggtattatttccacacttacaatcaattatttgtgggcaaagacctatggctcccatgtcatgttgatcaactggtttgttccatggttatgggttaaccactggttagtatttgtcacatttttgcaacacactgacccaaccatgcctcattacgaagccagtgaatggaccttcgctaaaggtgctgctgccaccattgatagaaactttggctttgttggtcaacatattttccacgatattattgaaacgcatgttttgcatcattactgttcaagaattcctttctacaacgctcgtgtagccactgaagctattaagaaagttatgggtgaacattatcgttatgaaggcgaaaatatgtggcaatcattatggaaggtggcaagatcctgtcagtttgtagatggtgacaacggtgttttgatgttcagaaacacaaacggagtcggagcaccatgtcaagaatga

SEQ ID NO: 384 - protein, 415 aa, Kluyveromyces lactis (GenBank Accession No. XM_451551); identical to SEQ ID NO: 378
  MISC_FEATURE: delta-15 desaturase

SEQ ID NO: 385 - protein, 433 aa, Candida albicans SC5314  (GenBank Accession No. EAL03493)
  MISC_FEATURE: delta-15 desaturase
MSVVEASSSSVVEDSTASNVVQRGNISSFASTTASSNLTTIDTNGKVFKVPDYSIKDILQAIPKHCYERSLIRSLGYVVRDITMMVIIGYVGHTFIPMVQIPEYPSLAYGLRGALWMVQSYCIGLFGFGLWILAHECGHGAFSDYQNINDFIGWVLHSYLIVPYFSWKFSHAKHHKATGHLTKDMVFIPYTKEEYLEKNKVEKVADLMEESPIYSFLVLVFQQLGGLQLYLATNATGQVYPGYSKIAKSHYTPTSPVFDKHQYWYIVLSDIGIILAFTTVYQWYKNFGLFNMMINWFVPWLWVNHWLVFVTFLQHTDPTMPHYTSKEWTFARGAAATIDRNFGFVGQHIFHDIIETHVLHHYVSRIPFYNAREATDAIRKVMGEHYRYEGESMWYSLWKCMRMCQFVDDDKEDAKGVMMFRNVNGWGPVKPKD

SEQ ID NO: 386 - protein, 419 aa, Saccharomyces kluyveri (GenBank Accession No. BAD11952)
  MISC_FEATURE: delta-15 desaturase
MSIETVGSSSGVAINSKAVSSTATTVVQPKTAIDTNGNVFKVPDYTIKDILSAIPKECYKRDTLWSLHYVVRDIAAILVIGYLGTNYIPVLFPNSALLRGIAYAIQSYLIGLFGFGLWILAHECGHSAFSESNAVNDTVGWVLHSWWMVPYFPWKFSHSKHHKATGHMTRDMVFIPYTKDEFITMKKKSKFAEITEEAPVMTLFNLIAQQVGGLQLYLATNATGQPYPGVKKFFKSHYWPTSPVFDAKDFWWIIMSDIGIVSTLLINYLWYRAYGAHVVLINWFIPWLWVNHWLVFVTFLQHTDPTMPHYDAEEWTFAKGAAATIDRNFGFVGQHIFHDIIETHVLHHYCSRIPFYNARKATSAIKEVMGQHYRYEGENMWKSLWKVARSCQYVEGDNGVRMFRNTNGVGVKPEDGSSQ

SEQ ID NO: 387 - protein, 435 aa, Debaryomyces hansenii CBS767  (GenBank Accession No. CAG88182)
  MISC_FEATURE: delta-15 desaturase
MSVVDLTSTTSGSAINSSNISQRGNGSTIVETKKGPSSNLKAIDTFGNEFKVPDYTIKQILSAIPKHCYERSLVRSLGYVARDITMMCLIGYVGQKTIPMVQIADQEGLSTAIRGGLWCVYSYLLGLFGFGLWILAHECGHGAFSDYQNVNDVVGWILHSYLIVPYFSWKFSHSKHHKATGHLTKDMVFIPYTKDEFVEKSGVSKVSEVMEDSPIWSLMVLIFQQIGGLQLYLATNATGQSYQGHSKIAKSHYAPASPVFDKEHYWYIILSDIGIITTITVVYQWYKNFGFFNMFVNWFMPWLWVNHWLVFVTFLQHTDPTMPHYRDNEWTFARGAAATIDRNFGFIGQHIFHDIIETHVLHHYVSRIPFYNAREATDAIRKVMGEHYRYEGESMWYSLWKCMRMCQYVDDADTDAKGVLMYRNVNGAGPVKPID

SEQ ID NO: 388 - protein, 396 aa, Aspergillus fumigatus (GenBank Accession No. EAL85733)
  MISC_FEATURE: delta-15 desaturase
MAGKMAEVRQRDVQTETEVVQDSIPSLKSLKDAIPKECFESSLAISFLYLARDILYCAILTYGAFHIHLLPSLPLRVLAWATYGFFQGCVGTGMWILAHECGHGAFSPYQGINDFIGWATHSFLLVPYFSWKITHARHHRYTGHMEKDTVFVPWTDEQLAKKRNVRIEQLKHFAEETPIVSFLQLIGHQLGGWQLYLLTNATAGAQSWPEGKPKTGPASHFNPVGALWTPSQRLSIAISDLGLLIMAAVLYYASTQIGAWNVVLLYFVPYLWVHHWLIAITYLQHTHPSVPHYTPEAWTYTKGALATVDRTMGFIGRHFFHEIIDYHVVHHLFSRIPFYKAEQATWAIQPLLGAQYHEEKEQSFLGSLVTTFRKCIYVSATGQPGVLHFVKADEGN

SEQ ID NO: 389 - DNA, 1000 bp, Yarrowia lipolytica
  misc_feature: Promoter EXP1
ggagtttggcgcccgttttttcgagccccacacgtttcggtgagtatgagcggcggcagattcgagcgtttccggtttccgcggctggacgagagcccatgatgggggctcccaccaccagcaatcagggccctgattacacacccacctgtaatgtcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcatgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagca

SEQ ID NO: 390 - DNA, 10189 bp, Artificial Sequence
  Plasmid pY72
taactttggccggccagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgctatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgcctgcaggataacttcgtataatgtatgctatacgaagttatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaaaggatccactagttctagagcggccgcttaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcgataacttcgtataatgtatgctatacgaagttatcgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaat

SEQ ID NO: 391 - DNA, 12558 bp, Artificial Sequence
  Plasmid pY80
taacgcggacacaatatctggtcaaatttcagtttcgttacataaatcgttatgtcaaaggagtgtgggaggttaagagaattatcaccggcaaactatctgttaattgctaggtacctctagacgtccacccgggtcgcttggcggccgaagaggccggaattcgggccgcggtggcggccgcctagtccttgttccatcgcatggcaccgggtcgggcagggtcgtgctcgacgtacttgagcgtgccgaagatggtccacagctggcccaggaagcttcggtcgtcgtggcagtagtggtcgccaatgacgggcttgatggcctcggtggcctcgtcagccttgtagaaggggatcttagggaagagatggtgaacaacgtgcttctcaatgataccgtggaagaggtgctttccgatgaagccaaactcacggtcgacagtggcgagagctcccttgacgtaggtccagccctcagcggtgtagtgagggagctcggtgtggtggtggtggaggtaggtaatggcaacgagccagtggtgaacccacaggtagggaacaaggtagaggaagagaatggtcgaaacaccaacttgcttggaagcaaagtacagagcagttcccattagagcaagaccgatatcggagatgaggatgaagatggcctcgttggggcggaagacagcgctggtaggctcgaagtgactgactcggaaccacttggagaggccagtcttgggctcccactgcttgctgcccttgccagagctagcgttgaagaagaggtacgcctgccatccgaaaagctggtggaagatgagcttgaccatctgagcagcgggggtgtcctcaacaagctcggcgacgtcaatgccagcaatcatgagcgacttggagggcttgggctcagtcttggggacgaaagccatgtcgagatccatgtggccggtgaagcggtggtggcggtggtgagagtacttccagctgaagtaggggacgaggaggaacgagtggaggaaccagccggtcacattgttgacctttccgtggagagagaaagcaccgtggccgcactcatggccgagaatccagacaccggtgcagaacagaccctggacgaagccgtagaccatccaagctgcgacgcggagggtctggtcggggatgctggggatgtaggtgagagcagcccagacgagggcagagaccatggcaaaatcgcggaagacgtagtagaatgaggtgacgagcgagggctggaagcagtgcgcgggaatggcatccttgatggtcttgatatcggggaacacaggttcagacttggcctcaagagtgaccttgggaaggtcctcgaccacaacagtggtggcagttcgctgtcgagtcgccattgtgcggccgcggattgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatcgatatccgcaaggttccatggcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtcgaggccggccagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgctatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactaggcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgcctgcaggataacttcgtataatgtatgctatacgaagttatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaaaggatccactagttctagagcggccgcttaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcgataacttcgtataatgtatgctatacgaagttatcgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaat

SEQ ID NO: 392 - DNA, 8982 bp, Artificial Sequence
  Plasmid pY79
ggtggagctccagcttttgttccctttagtgagggttaatttcgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcgtcgactcaggcgacgacggaattcctgcagcccatctgcagaattcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatgtccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaaggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgc

SEQ ID NO: 393 - DNA, 10424 bp, Artificial Sequence
  Plasmid pY86
  misc_feature (8734)..(8734): n is a, c, g, or t
  misc_feature (8739)..(8742): n is a, c, g, or t
acactgtggccggcctttacctgcaggataacttcgtataatgtatgctatacgaagttatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaaaggatccactagttctagagcggccgcttaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagcggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcgataacttcgtataatgtatgctatacgaagttatcgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaacgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgcgcctacttaagcaacgggcttgataacagcggggggggtgcccacgttgttgcggttgcggaagaacagaacacccttaccagcaccctcggcaccagcgctgggctcaacccactggcacatacgcgcactgcggtacatggcgcggatgaagccacgaggaccatcctggacatcagcccggtagtgcttgcccatgatgggcttaatggcctcggtggcctcgtccgcgttgtagaaggggatgctgctgacgtagtggtggaggacatgagtctcgatgatgccgtggagaaggtggcggccgatgaagcccatctcacggtcaatggtagcagcggcaccacggacgaagttccactcgtcgttggtgtagtggggaagggtagggtcggtgtgctggaggaaggtgatggcaacgagccagtggttaacccagaggtagggaacaaagtaccagatggccatgttgtagaaaccgaacttctgaacgaggaagtacagagcagtggccatcagaccgataccaatatcgctgaggacgatgagcttagcgtcactgttctcgtacagagggctgcggggatcgaagtggttaacaccaccgccgaggccgttatgcttgcccttgccgcgaccctcacgctggcgctcgtggtagttgtggccggtaacattggtgatgaggtagttgggccagccnacgannnnctcagtaagatgagcgagctcgtgggtcatctttccgagacgagtagcctgctgctcgcgggttcggggaacgaagaccatgtcacgctccatgttgccagtggccttgtggtgctttcggtgggagatttgccagctgaagtaggggacaaggagggaagagtgaagaacccagccagtaatgtcgttgatgatgcgagaatcggagaaagcaccgtgaccgcactcatgggcaataacccagagaccagtaccgaaaagaccctgaagaacggtgtacacggcccacagaccagcgcgggcgggggtggaggggatatattcgggggtcacaaagttgtaccagatgctgaaagtggtagtcaggaggacaatgtcgcggaggatataaccgtatcccttgagagcggagcgcttgaagcagtgcttagggatggcattgtagatgtccttgatggtaaagtcgggaacctcgaactggttgccgtaggtgtcgagcatgacaccatactcggacttgggcttggcgatatcaacctcggacatggacgagagcgatgtggaagaggccgagtggcggggagagtctgaaggagagacggcggcagactcagaatccgtcacagtagttgaggtgacggtgcgtctaagcgcagggttctgcttgggcagagccgaagtggacgccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaattgttcctctatagtactgcgt

SEQ ID NO: 394 - DNA, 10485 bp, Artificial Sequence
  Plasmid pY94
taaaaggcgttgaaacagaatgagccagacagcaaggacaaggtggccaacagcaaggagtccaaaaagccctctattgacgagatccacgatgttattgctcatgaggtttccgagctcgatgctgggaagaagaagtgatttgtatataagaaataaatgagatatagtaaaggagtgcaagagaatggcaaggtggtcaaattctatattacttgcagtcactggttcctcgttgacatgaatgaagttaccgttggcatagctgatttaatatataactgtccaactaactctcacctagatataacccatgtgtgtgtttccaatcatcaatgcggccgcttagagagccttgccagcgggctgcttctcggccattcgagcgaacacggccaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccaggagcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccacgaggttattccagtttcggttcttgaaggtctggtggtggcagatgtcatgagacagccatcccatttgctggtagtgcataccgagcagcacagcaccaatgaagtacatctggtactggaccatcaggaagtatccaagcacgccaagacccagggtggtggagatcttgtacgagtaccagaggggagaggcgtcaaacatgccagtggcgatcagctcttctcggagctttcggaaatcctcctgagcttcgttgacggcagcctggggaggcagctcggaggaggggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtaggtagttccgtcgatggtgaggggcagagcctgtcgcttggacttcaccatggagagctgggttagtttgtgtagagagtgtgtgttgctagcgactttcggattgtgtcattacacaaaacgcgtcgtctcgacactgatcttgtcgtggatactcacggctcggacatcgtcgccgacgatgacaccggactttcgcttaaggacgtcagtaacaggcattgtgtgatgtgtagtttagatttcgaatctgtggggaaagaaaggaaaaaagagactggcaaccgattgggagagccactgtttatatataccctagacaagccccccgcttgtaagatgttggtcaatgtaaaccagtattaaggttggcaagtgcaggagaagcaaggtgtgggtaccgagcaatggaaatgtgcggaaggcaaaaaaatgaggccacggcctattgtcggggctatatccagggggcgattgaagtacactaacatgacatgtgtccacagaccctcaatctggcctgatgagccaaatccatacgcgctttcgcagctctaaaggctataacaagtcacaccaccctgctcgacctcagcgccctcactttttgttaagacaaactgtacacgctgttccagcgttttctgcctgcacctggtgggacatttggtgcaacctaaagtgctcggaacctctgtggtgtccagatcagcgcagcagttccgaggtagttttgaggcccttagatgatgcaatggtgtcagtcgctggatcacgagtcttaatggcagtattcgttcttatttgtgccattgagccccgttatcctcgtatcttctaccccccatcccatccctttgttggtgcaaccctacccatttattgttgggtgcagcccaaccgacgtggagagcttggcttggccatataaaaaggcccccccctagtggcaatggcagaaagtcagctgtgagttgttgaatttgtcatctaggcggcctggccgtcttctccggggcaatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgctaaagctgcttaccagccttagcggatttcttggtggccaggttgtcctggtaaaagaagtgacagaacaggagaaagacagatccgacgtaggcgtagttgaaagcccaggagaacagcttgcccttgtcagagttgaagcagggaacgttgatgtagtcccagaccaggagaaagccaccgacgaactggcaaatctgcatggcagtgatcagaggcttggccttgaacttgtagccagcggcagtcagtccatagtaggtgtacatgatggtgtgaatgaacgagttaaagaacatgaagatccacacaccctcgttgtgcagtcgaatgccgaggtagacgtcccagggagctccaaagtgatggaaggcctgcagaaaggacactcgcttgcccttgaggaccagccaagcggtgtcgaggtactccacgtacttagaatagtagaaggccttggcagtccaggtgaacagcttggagtcccagacaggagagggacactgaaagagaggctggggagtatcaccggtctgtcttcgcagccaggctccagtaccgtagtcccagccgagagcggtggcagtcacgtagaaggacagggcagagaagagagccaggaggacgttgtaccagatcatggaggttcggtaggctcctttcttctcgtccacgagaccagagtttcgcaggagaggcttcaggagcaggtaggagaaggtgccaatgaggatttcgggatcggtgacggcagcccagattcgctcgccagcgtcgttggccagagccatggttagcgtgtcgtgtttttgttgtgctggaagaaccaaagggtggcgcaatgtgtgtagatatatatgtcgtgacccacaagtcacacaaacaagtatcgggaggagtggtgcacctctatgcggagaaaccttataccgctgtagaccaactggggcagaggtgtgagttgaagtcagctggaggagatgtgtgacagaagcacaagaagtgagattgtgagatgtatgtctagggggggaagttttgtgtcaaatatatgggaattattatcagcaccacgaaattatacgcctcatatgacccatttaggtggatagatcatggacactgttgacagctgcgaagaaaaagcgtattggggatgatccgaaattagtccggtaccgaggcgcaaatacgtaagacagccgatwaaatatatgcgagaaacaccaaagagactctagatgtttgtttggcacagttttgacttctgcgaaggccttacaccaccttgttgacccttgtcgcgggtcgggcaatatcggctgacagagttttacttgctcaataagatacgagctgcatagagttgaactacaggacaatattggggctggccacatgaagggcattgtttggaggtgtattgatggtgaaaacacgatatgaaatgacaacgccccctgttttattattattcttattattttgggtgcttctctatccatacaagcacctcctaacatgcttcataagtgacctcctcatcacaaggcctgaggtctcatttatccagtggcgccaagctaaactaaaactggtccgagtagactaaggcgaagagagaaggagagaagacagtttttttgtggccgcctgtgaacaatgaaaacgatgagggtgagatggagcaaaccatatggacagtcagaggagtacgtacgctgcttacataatggcgcaacgaccacatgtcccacagatacgcatccgtacggtgagatctatacctaggataacttcgtatagcatacattatacgaagttatatcgatgagtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaaggagagaattcataacttcgtatagcatacattatacgaagttatcctgcaggtaaaggccggccgatgtatatcgtattcattcatgttagttgcgtacgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaat

SEQ ID NO: 395 - DNA, 8423 bp, Artificial Sequence
  Plasmid pY91M
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatgggtggcggaggacagcagacagaccgaatcaccgacaccaacggcagattcagcagctacacctgggaggaggtgcagaaacacaccaaacatggagatcagtgggtggtggtggagaggaaggtttataacgtcagccagtgggtgaagagacaccccggaggactgaggatcctcggacactatgctggagaagacgccacggaggcgttcactgcgtttcatccaaaccttcagctggtgaggaaatacctgaagccgctgctaatcggagagctggaggcgtctgaacccagtcaggaccggcagaaaaacgctgctctcgtggaggatttccgagccctgcgtgagcgtctggaggctgaaggctgttttaaaacgcagccgctgtttttcgctctgcatttgggccacattctgctcctggaggccatcgctttcatgatggtgtggtatttcggcaccggttggatcaacacgctcatcgtcgctgttattctggctactgcacagtcacaagctggatggttgcagcatgacttcggtcatctgtccgtgtttaaaacctctggaatgaatcatttggtgcacaaatttgtcatcggacacctgaagggagcgtctgcgggctggtggaaccatcggcacttccagcatcacgctaaacccaacatcttcaagaaggacccggacgtcaacatgctgaacgcctttgtggtgggaaacgtgcagcccgtggagtatggcgttaagaagatcaagcatctgccctacaaccatcagcacaagtacttcttcttcattggtcctcccctgctcatcccagtgtatttccagttccaaatctttcacaatatgatcagtcatggcatgtgggtggacctgctgtggtgtatcagctactacgtccgatacttcctttgttacacgcagttctacggcgtcttttgggctattatcctctttaatttcgtcaggtttatggagagccactggtttgtttgggtcacacagatgagccacatccccatgaacattgactatgagaaaaatcaggactggctcagcatgcagctggtcgcgacctgtaacatcgagcagtctgccttcaacgactggttcagcggacacctcaacttccagatcgagcatcatctctttcccacaatgcctcggcacaactactggcgcgccgctccacgggtgcgagcgttgtgtgagaaatacggagtcaaataccaagagaagaccttgtacggagcatttgcggatatcattaggtctttggagaaatctggcgagctctggctggatgcgtatctcaacaaataagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgc

SEQ ID NO: 396 - DNA, 25 bp, Artificial Sequence
  Primer 410
ttccctagtcccagtgtacacccgc

SEQ ID NO: 397 - DNA, 25 bp, Artificial Sequence
  Primer 411
agagagactgcagctgggtgaccat

SEQ ID NO: 398 - DNA, 27 bp, Artificial Sequence
  Primer 412
gtatggtcacccagctgcagtctctct

SEQ ID NO: 399 - DNA, 25 bp, Artificial Sequence
  Primer 413
gaggtgtgctggattcatgaccaca

SEQ ID NO: 400 - DNA, 44 bp, Artificial Sequence
  Primer 414
ctggtaaataaatgatgttccctagtcccagtgtacacccgccg

SEQ ID NO: 401 - DNA, 42 bp, Artificial Sequence
  Primer 415
tatgcttccggctcgtacgaggtgtgctggattcatgaccac

SEQ ID NO: 402 - DNA, 32 bp, Artificial Sequence
  Primer YL325
tttgcggccgcatggagcgtgtgttctgagtc

SEQ ID NO: 403 - DNA, 46 bp, Artificial Sequence
  Primer YL326
cccttaattaactcacctgcaggattgagactatgaatggattccc

SEQ ID NO: 404 - protein, 5 aa, Artificial Sequence
  His Box 1
HECGH

SEQ ID NO: 405 - protein, 8 aa, Artificial Sequence
  Delta-15 desaturase motif
  misc_feature (2)..(3): Xaa can be any naturally occurring amino acid
IXXHECGH

SEQ ID NO: 406 - protein, 8 aa, Artificial Sequence
  Delta-12 desaturase motif
  misc_feature (2)..(3): Xaa can be any naturally occurring amino acid
VXXHECGH

SEQ ID NO: 407 - DNA, 34 bp, Escherichia coli
ataacttcgtataatgtatgctatacgaagttat

SEQ ID NO: 408 - DNA, 45 bp, Artificial Sequence
  Primer 436
tatctgctgtcgtggttaattaacgcggacacaatatctggtcaa

SEQ ID NO: 409 - DNA, 40 bp, Artificial Sequence
  Primer 437
ctgcaggtaaaggccggcctcgacgcagtaggatgtcctg

SEQ ID NO: 410 - DNA, 38 bp, Artificial Sequence
  Primer 475
ccatccacacttgcggccgcttatttgttgagatacgc

SEQ ID NO: 411 - DNA, 38 bp, Artificial Sequence
  Primer 477
acaagcttgcggccgcttatttgttgagatacgcatcc

SEQ ID NO: 412 - DNA, 35 bp, Artificial Sequence
  Primer 478
agtggctctccataaacctgacgaaattaaagagg

SEQ ID NO: 413 - DNA, 40 bp, Artificial Sequence
  Primer 476
ctagtggatccgaattccatgggtggcggaggacagcaga

SEQ ID NO: 414 - DNA, 36 bp, Artificial Sequence
  Primer 505
catcatctctttcccacagtgcctcggcacaactac

What is claimed is:

1. A recombinant oleaginous Yarrowia yeast cell for the production of eicosapentaenoic acid comprising:
at least one gene encoding delta-8 desaturase polypeptide having at least 95% identity to the amino acid sequence set forth in SEQ ID NO:62, wherein the oleaginous Yarrowia yeast cell accumulates in excess of about 25% of its dry cell weight as oil and the oleaginous Yarrowia yeast cell produces at least 9% eicosapentaenoic acid of total lipids produced, wherein the polypeptide has delta-8 desaturase activity.

2. The oleaginous Yarrowia yeast cell of claim 1, comprising at least one gene encoding delta-12 desaturase having at least 95% identity to the amino acid sequence set forth in SEQ ID NO:28, wherein the polypeptide has delta-12 desaturase activity.

3. The oleaginous Yarrowia yeast cell of claim 2, wherein the Yarrowia is devoid of any native gene encoding a polypeptide having delta-12 desaturase activity.

4. The oleaginous Yarrowia yeast cell of claim 1, wherein at least one gene encoding delta-8 desaturase is under the control of a promoter sequence having a nucleic acid sequence selected from the group consisting of SEQ ID NOs: 173-183 and 389.

5. The oleaginous Yarrowia yeast cell of claim 1, further comprising at least one gene encoding C16/18 elongase having at least 95% identity to the amino acid sequence set forth in SEQ ID NO:67, wherein the polypeptide has C16/18 elongase activity.

6. The oleaginous Yarrowia yeast cell of claim 1, wherein the cell produces microbial oil comprising eicosapentaenoic acid and wherein the microbial oil is devoid of any gamma-linolenic acid.

7. The oleaginous Yarrowia yeast cell of claim 1, wherein the cell produces microbial oil comprising eicosapentaenoic acid and wherein the microbial oil is devoid of any docosahexaenoic acid.

8. The oleaginous Yarrowia yeast cell of claim 1, wherein the cell produces microbial oil comprising both eicosapentaenoic acid and gamma-linolenic acid, and wherein the ratio of eicosapentaenoic acid and gamma-linolenic acid is about 1:1.

9. A method for the production of microbial oil comprising eicosapentaenoic acid comprising:
a) culturing the Yarrowia yeast cell of claim 1 to produce oil, wherein the microbial oil comprising eicosapentaenoic acid; and
b) recovering the microbial oil of step (a).

10. A recombinant production host useful for the production of eicosapentaenoic acid selected from the group consisting of: Yarrowia lipolytica Y2047 having the ATCC designation ATCC 7186 Yarrowia lipolytica Y2201 having the ATCC designation ATCC 7185 and Yarrowia lipolytica Y2096 having the ATCC designation ATCC 7184.

* * * * *